United States Patent 12,508,308 (INFLUENZA mRNA VACCINES) - sequence listing, part 19

SEQ ID NO: 68562 - RNA, 1701 nt, Artificial Sequence
  derived and/or modified sequence opt1 from hemagglutinin__InfluenzaA__AEO01473
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccggagggcgccaucaacaccagccugcccuuccagaacauccaccccaucaccaucggggagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68563 - RNA, 1701 nt, Artificial Sequence
  derived and/or modified sequence opt1 from hemagglutinin__InfluenzaA__AEO01474
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68564 - RNA, 1701 nt, Artificial Sequence
  derived and/or modified sequence opt1 from hemagglutinin__InfluenzaA__AEO01475
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68565 - RNA, 1701 nt, Artificial Sequence
  derived and/or modified sequence opt1 from hemagglutinin__InfluenzaA__AEO01476
augaaggccauccuggugguccuccuguacaccuucagcaccgccaacgcggacacgcugugcaucggcuaccacgccaacaacuccaccgacaccguggacaccgugcucgagaagaacgucacggugacccacagcgugaaccugcuggaggacaagcacaacgggaagcucugcaagcugcgcggcgucgcgccccugcaccucgggaagugcaacaucgccggcuggauccuggggaacccggagugcgagucccugagcaccgccuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 68566 - RNA, 1701 nt, Artificial Sequence
  derived and/or modified sequence opt1 from hemagglutinin__InfluenzaA__AEO01477
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacgccuucgugggcacgucccgguacagcaagaaguucaagcccgagaucgcgauccgcccgaaggugcgggagcaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 68567 - RNA, 1701 nt, Artificial Sequence; identical to SEQ ID NO: 65005
  derived and/or modified sequence opt1 from hemagglutinin__InfluenzaA__AEO01478

SEQ ID NO: 68568 - RNA, 1701 nt, Artificial Sequence; identical to SEQ ID NO: 68395
  derived and/or modified sequence opt1 from hemagglutinin__InfluenzaA__AEO01479

SEQ ID NO: 68569 - RNA, 1701 nt, Artificial Sequence; identical to SEQ ID NO: 68442
  derived and/or modified sequence opt1 from hemagglutinin__InfluenzaA__AEO01480

SEQ ID NO: 68570 - RNA, 1701 nt, Artificial Sequence
  derived and/or modified sequence opt1 from hemagglutinin__InfluenzaA__AEO01482
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68571 - RNA, 1701 nt, Artificial Sequence
  derived and/or modified sequence opt1 from hemagglutinin__InfluenzaA__AEO01483
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgccgccuccagccugguccucguggugagccugggggccaucuccuucuggaugugcagcaacggcucccugcagugccggaucugcaucuga

SEQ ID NO: 68572 - RNA, 1701 nt, Artificial Sequence
  derived and/or modified sequence opt1 from hemagglutinin__InfluenzaA__AEO01484
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68573 - RNA, 1701 nt, Artificial Sequence
  derived and/or modified sequence opt1 from hemagglutinin__InfluenzaA__AEO01485
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucaccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 68574 - RNA, 1701 nt, Artificial Sequence
  derived and/or modified sequence opt1 from hemagglutinin__InfluenzaA__AEO01487
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugacccucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68575 - RNA, 1701 nt, Artificial Sequence
  derived and/or modified sequence opt1 from hemagglutinin__InfluenzaA__AEO01488
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacggcaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 68576 - RNA, 1701 nt, Artificial Sequence
  derived and/or modified sequence opt1 from hemagglutinin__InfluenzaA__AEO01489
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguuccgccccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68577 - RNA, 1701 nt, Artificial Sequence
  derived and/or modified sequence opt1 from hemagglutinin__InfluenzaA__AEO01490
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcaaccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccuccagccuggugcugguggucagccucggggccaucuccuucuggaugugcagcaacggcucccugcagugccggaucugcaucuga

SEQ ID NO: 68578 - RNA, 1701 nt, Artificial Sequence
  derived and/or modified sequence opt1 from hemagglutinin__InfluenzaA__AEO01491
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaaguacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68579 - RNA, 1701 nt, Artificial Sequence; identical to SEQ ID NO: 68446
  derived and/or modified sequence opt1 from hemagglutinin__InfluenzaA__AEO01492

SEQ ID NO: 68580 - RNA, 1701 nt, Artificial Sequence
  derived and/or modified sequence opt1 from hemagglutinin__InfluenzaA__AEO01493
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcuccgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggcgaccggccuccgcaacgucccgagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 68581 - RNA, 1701 nt, Artificial Sequence
  derived and/or modified sequence opt1 from hemagglutinin__InfluenzaA__AEO01494
augaaggccauccuggugguccuccuguacaccuucgccaccgcgaacgccgacacgcugugcaccggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68582 - RNA, 1701 nt, Artificial Sequence; identical to SEQ ID NO: 65274
  derived and/or modified sequence opt1 from hemagglutinin__InfluenzaA__AEO01496

SEQ ID NO: 68583 - RNA, 1701 nt, Artificial Sequence; identical to SEQ ID NO: 64030
  derived and/or modified sequence opt1 from hemagglutinin__InfluenzaA__AEO01497

SEQ ID NO: 68584 - RNA, 1701 nt, Artificial Sequence; identical to SEQ ID NO: 65274
  derived and/or modified sequence opt1 from hemagglutinin__InfluenzaA__AEO01498

SEQ ID NO: 68585 - RNA, 1701 nt, Artificial Sequence
  derived and/or modified sequence opt1 from hemagglutinin__InfluenzaA__AEO01499
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccuacaccagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagcacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucaacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68586 - RNA, 1701 nt, Artificial Sequence; identical to SEQ ID NO: 64778
  derived and/or modified sequence opt1 from hemagglutinin__InfluenzaA__AEO01500

SEQ ID NO: 68587 - RNA, 1701 nt, Artificial Sequence; identical to SEQ ID NO: 64841
  derived and/or modified sequence opt1 from hemagglutinin__InfluenzaA__AEO01501

SEQ ID NO: 68588 - RNA, 1701 nt, Artificial Sequence; identical to SEQ ID NO: 64841
  derived and/or modified sequence opt1 from hemagglutinin__InfluenzaA__AEO01502

SEQ ID NO: 68589 - RNA, 1701 nt, Artificial Sequence; identical to SEQ ID NO: 65097
  derived and/or modified sequence opt1 from hemagglutinin__InfluenzaA__AEO01503

SEQ ID NO: 68590 - RNA, 1701 nt, Artificial Sequence; identical to SEQ ID NO: 65274
  derived and/or modified sequence opt1 from hemagglutinin__InfluenzaA__AEO01505

SEQ ID NO: 68591 - RNA, 1701 nt, Artificial Sequence; identical to SEQ ID NO: 64778
  derived and/or modified sequence opt1 from hemagglutinin__InfluenzaA__AEO01506

SEQ ID NO: 68592 - RNA, 1701 nt, Artificial Sequence; identical to SEQ ID NO: 68386
  derived and/or modified sequence opt1 from hemagglutinin__InfluenzaA__AEO01507

SEQ ID NO: 68593 - RNA, 1701 nt, Artificial Sequence; identical to SEQ ID NO: 65274
  derived and/or modified sequence opt1 from hemagglutinin__InfluenzaA__AEO01508

SEQ ID NO: 68594 - RNA, 1701 nt, Artificial Sequence; identical to SEQ ID NO: 65005
  derived and/or modified sequence opt1 from hemagglutinin__InfluenzaA__AEO01510

SEQ ID NO: 68595 - RNA, 1701 nt, Artificial Sequence
  derived and/or modified sequence opt1 from hemagglutinin__InfluenzaA__AEO01511
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccaccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucacggccgcgugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgcggacgccuacguguucgugggcaccucccgguacagcaagaaguucaagcccgagaucgccauccgcccgaagguccgggagcaggagggccgcaugaacuacuacuggacccugguggagcccggggacaagaucacguucgaggccaccggcaaccucguggucccccgguacgccuucgcgauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 68596 - RNA, 1701 nt, Artificial Sequence
  derived and/or modified sequence opt1 from hemagglutinin__InfluenzaA__AEO01512
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacaagugcauggagagcgugaagaacgggaccuacgacuaccccaaguacuccgaggaggccaagcugaaccgggaggagaucgacggcgugaagcucgagagcacgcgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68597 - RNA, 1701 nt, Artificial Sequence
  derived and/or modified sequence opt1 from hemagglutinin__InfluenzaA__AEO01513
augaaggccauccuggccgugcuccuguacaccuucgcgaccgccaacgccgacacgcugugcaucggcuaccacgccaacaacagcaccgacaccgucgacaccgugcucgagaagaacgugacggucacccacuccgugaacauccuggaggacaagcacaacgggaagcugugcaagcuccgcggcguggcgccccugcaccuggggaagugcaacaucgccggcuggauccucgggaacccggagugcgagagccuguccaccgccagcuccuggagcuacaucgucgagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcuggucaagaaggggaacagcuaccccaagcucuccaagagcuacaucaacgacaagggcaaggaggugcuggugcugugggggauccaccaccccagcaccuccgccgaccagcagagccucuaccagaacgccgacgccuacgucuucgugggcuccagccgguacuccaagaaguucaagcccgagaucgcgauccgcccgaaggugcgggaccaggagggccgcaugaacuacuacuggacgcuggucgagcccggggacaagaucaccuucgaggccaccggcaaccugguggugccccgguacgccuucgccauggagcgcaacgccgggagcggcaucaucaucuccgacacccccguccacgacugcaacacgaccugccagaccccgaagggcgcgaucaacaccagccuccccuuccagaacauccaccccgugacgaucgggaagugccccaaguacgugaaguccaccaagcugcggcuggccaccggccuccgcaacgucccgagcauccagucccgggggcuguucggcgccaucgccggguucaucgagggcggcuggaccgggaugguggacggcugguacggguaccaccaccagaacgagcagggcagcggguacgccgcggaccugaaguccacgcagaacgccaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcuggaguccacccgcaucuaccagauccucgccaucuacagcaccgucgccagcucccuggugcugguggucagccucggggccaucuccuucuggaugugcagcaacggcucccugcagugccggaucugcaucuga

SEQ ID NO: 68598 - RNA, 1701 nt, Artificial Sequence
  derived and/or modified sequence opt1 from hemagglutinin__InfluenzaA__AEO01514
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaugcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68599 - RNA, 1701 nt, Artificial Sequence; identical to SEQ ID NO: 65864
  derived and/or modified sequence opt1 from hemagglutinin__InfluenzaA__AEO01515

SEQ ID NO: 68600 - RNA, 1701 nt, Artificial Sequence; identical to SEQ ID NO: 68446
  derived and/or modified sequence opt1 from hemagglutinin__InfluenzaA__AEO01516

SEQ ID NO: 68601 - RNA, 1701 nt, Artificial Sequence
  derived and/or modified sequence opt1 from hemagglutinin__InfluenzaA__AEO01517
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccggagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 68602 - RNA, 1701 nt, Artificial Sequence
  derived and/or modified sequence opt1 from hemagglutinin__InfluenzaA__AEO01518
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggaucgugaagaaggggaacagcuaccccaagcucaacaaguccuacaucaacgacaagggcaaggaggugcugguccugugggggauccaccaccccagcaccagcgccgaccagcagucccucuaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccuccccuuccagaacauccaccccaucaccaucggggagugccccaaguacgugaaguccaccaagcugcggcuggcgaccggccuccgcaacgucccgagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccuccagccuggugcugguggucagccucggggccaucuccuucuggaugugcagcaacggcucccugcagugccggaucugcaucuga

SEQ ID NO: 68603 - RNA, 1701 nt, Artificial Sequence
  derived and/or modified sequence opt1 from hemagglutinin__InfluenzaA__AEO01519
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguuccgccccgagaucgccauccggccgaagguccgcgagcaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 68604 - RNA, 1701 nt, Artificial Sequence; identical to SEQ ID NO: 66582
  derived and/or modified sequence opt1 from hemagglutinin__InfluenzaA__AEO01520

SEQ ID NO: 68605 - RNA, 1701 nt, Artificial Sequence; identical to SEQ ID NO: 65304
  derived and/or modified sequence opt1 from hemagglutinin__InfluenzaA__AEO01521

SEQ ID NO: 68606 - RNA, 1701 nt, Artificial Sequence; identical to SEQ ID NO: 67096
  derived and/or modified sequence opt1 from hemagglutinin__InfluenzaA__AEO01522

SEQ ID NO: 68607 - RNA, 1701 nt, Artificial Sequence; identical to SEQ ID NO: 64841
  derived and/or modified sequence opt1 from hemagglutinin__InfluenzaA__AEO01523

SEQ ID NO: 68608 - RNA, 1701 nt, Artificial Sequence; identical to SEQ ID NO: 68435
  derived and/or modified sequence opt1 from hemagglutinin__InfluenzaA__AEO01524

SEQ ID NO: 68609 - RNA, 1701 nt, Artificial Sequence
  derived and/or modified sequence opt1 from hemagglutinin__InfluenzaA__AEO01525
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuacccccggcuguccaagagcuacaucaacgacaaggggaaggaggugcugguccucuggggcauccaccaccccagcaccuccgccgaccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 68610 - RNA, 1701 nt, Artificial Sequence; identical to SEQ ID NO: 64841
  derived and/or modified sequence opt1 from hemagglutinin__InfluenzaA__AEO01526

SEQ ID NO: 68611 - RNA, 1701 nt, Artificial Sequence; identical to SEQ ID NO: 67618
  derived and/or modified sequence opt1 from hemagglutinin__InfluenzaA__AEO01527

SEQ ID NO: 68612 - RNA, 1701 nt, Artificial Sequence
  derived and/or modified sequence opt1 from hemagglutinin__InfluenzaA__AEO01529
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggagaagaucgacggcgucaagcuggaguccacccgcaucuaccagauccucgcgaucuacagcaccgccgccagcucccuggugcugguggucagccucggggccaucuccuucuggaugugcagcaacggcucccugcagugccggaucugcaucuga

SEQ ID NO: 68613 - RNA, 1701 nt, Artificial Sequence; identical to SEQ ID NO: 64841
  derived and/or modified sequence opt1 from hemagglutinin__InfluenzaA__AEO01530

SEQ ID NO: 68614 - RNA, 1701 nt, Artificial Sequence
  derived and/or modified sequence opt1 from hemagglutinin__InfluenzaA__AEO01531
augaaggccauccuggugguccuccuguacaccuucgccaccgcgaacacggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggagcaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcgucuaccagauccuggccaucuacuccaccguggcgagcagccuggugcucgucgugucccugggggccaucagcuucuggaugugcuccaacggcagccugcagugccggaucugcaucuga

SEQ ID NO: 68615 - RNA, 1701 nt, Artificial Sequence; identical to SEQ ID NO: 68446
  derived and/or modified sequence opt1 from hemagglutinin__InfluenzaA__AEO01532

SEQ ID NO: 68616 - RNA, 1701 nt, Artificial Sequence
  derived and/or modified sequence opt1 from hemagglutinin__InfluenzaA__AEO01533
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68617 - RNA, 1701 nt, Artificial Sequence
  derived and/or modified sequence opt1 from hemagglutinin__InfluenzaA__AEO01534
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgcggagcugguccuacaucguggagaccagcuccagcgacaacggcacgugcuaccccggcgacuucaucgacuacgaggagcuccgcgagcagcuguccagcguguccagcuucgagcgguucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagcacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 68618 - RNA, 1701 nt, Artificial Sequence; identical to SEQ ID NO: 65326
  derived and/or modified sequence opt1 from hemagglutinin__InfluenzaA__AEO01535

SEQ ID NO: 68619 - RNA, 1701 nt, Artificial Sequence; identical to SEQ ID NO: 64841
  derived and/or modified sequence opt1 from hemagglutinin__InfluenzaA__AEO01536

SEQ ID NO: 68620 - RNA, 1701 nt, Artificial Sequence; identical to SEQ ID NO: 66582
  derived and/or modified sequence opt1 from hemagglutinin__InfluenzaA__AEO01537

SEQ ID NO: 68621 - RNA, 1701 nt, Artificial Sequence
  derived and/or modified sequence opt1 from hemagglutinin__InfluenzaA__AEO01538
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 68622 - RNA, 1701 nt, Artificial Sequence; identical to SEQ ID NO: 65304
  derived and/or modified sequence opt1 from hemagglutinin__InfluenzaA__AEO01539

SEQ ID NO: 68623 - RNA, 1701 nt, Artificial Sequence
  derived and/or modified sequence opt1 from hemagglutinin__InfluenzaA__AEO01540
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggaccucccgguacagcaagaaguucaagcccgagaucgccauccgcccgaagguccgggaccaggagggccgcaugaacuacuacuggacgcugguggagcccggcgacaagaucaccuucgaggcgaccgggaaccucguggucccccgguacgccuucgccauggagcgcaacgccggcuccgggaucaucaucagcgacacccccgugcacgacugcaacacgaccugccagaccccgaagggcgccaucaacaccucccugcccuuccagaacauccaccccaucacgaucggcaagugccccaaguacgucaagagcaccaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacgcagcacgcgaucgacgagaucaccaacaaggugaacuccgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucaacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 68624 - RNA, 1701 nt, Artificial Sequence; identical to SEQ ID NO: 65097
  derived and/or modified sequence opt1 from hemagglutinin__InfluenzaA__AEO01541

SEQ ID NO: 68625 - RNA, 1701 nt, Artificial Sequence; identical to SEQ ID NO: 64841
  derived and/or modified sequence opt1 from hemagglutinin__InfluenzaA__AEO01542

SEQ ID NO: 68626 - RNA, 1701 nt, Artificial Sequence; identical to SEQ ID NO: 64778
  derived and/or modified sequence opt1 from hemagglutinin__InfluenzaA__AEO01543

SEQ ID NO: 68627 - RNA, 1701 nt, Artificial Sequence; identical to SEQ ID NO: 64778
  derived and/or modified sequence opt1 from hemagglutinin__InfluenzaA__AEO01544

SEQ ID NO: 68628 - RNA, 1701 nt, Artificial Sequence
  derived and/or modified sequence opt1 from hemagglutinin__InfluenzaA__AEO01545
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacagcgggaagcucugcaagcugcgcggcgucgcgccccugcaccucgggaagugcaacaucgccggcuggauccuggggaacccggagugcgagucccugagcaccgcguccagcugguccuacaucguggagaccagcuccagcgacaacggcacgugcuaccccggcgacuucguggacuacgaggagcuccgggagcagcuguccagcgucuccagcuucgagcgcuucgagaucuuccccaagaccuccagcuggcccaaccacgacuccaacaagggggugaccgccgccugcccgcacgccggcgccaagagcuucuacaagaaccugaucuggcucgugaagaaggggaacuccuaccccaagcugagcaagagcuacaucaacgacaagggcaaggagguccuggugcucugggggauccaccaccccuccaccagcgccgaccagcagucccuguaccagaacgccgacgccuacguguucgucggcacgagccgguacuccaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcugcggcucgcgaccggccugcgcaacgugccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 68629 - RNA, 1701 nt, Artificial Sequence; identical to SEQ ID NO: 63664
  derived and/or modified sequence opt1 from hemagglutinin__InfluenzaA__AEO01546

SEQ ID NO: 68630 - RNA, 1701 nt, Artificial Sequence; identical to SEQ ID NO: 63664
  derived and/or modified sequence opt1 from hemagglutinin__InfluenzaA__AEO01547

SEQ ID NO: 68631 - RNA, 1701 nt, Artificial Sequence; identical to SEQ ID NO: 63857
  derived and/or modified sequence opt1 from hemagglutinin__InfluenzaA__AEO01548

SEQ ID NO: 68632 - RNA, 1701 nt, Artificial Sequence; identical to SEQ ID NO: 63768
  derived and/or modified sequence opt1 from hemagglutinin__InfluenzaA__AEO01549

SEQ ID NO: 68633 - RNA, 1701 nt, Artificial Sequence; identical to SEQ ID NO: 63677
  derived and/or modified sequence opt1 from hemagglutinin__InfluenzaA__AEO01550

SEQ ID NO: 68634 - RNA, 1701 nt, Artificial Sequence; identical to SEQ ID NO: 63677
  derived and/or modified sequence opt1 from hemagglutinin__InfluenzaA__AEO01551

SEQ ID NO: 68635 - RNA, 1701 nt, Artificial Sequence; identical to SEQ ID NO: 63677
  derived and/or modified sequence opt1 from hemagglutinin__InfluenzaA__AEO01552

SEQ ID NO: 68636 - RNA, 1701 nt, Artificial Sequence; identical to SEQ ID NO: 63677
  derived and/or modified sequence opt1 from hemagglutinin__InfluenzaA__AEO01553

SEQ ID NO: 68637 - RNA, 1701 nt, Artificial Sequence; identical to SEQ ID NO: 63677
  derived and/or modified sequence opt1 from hemagglutinin__InfluenzaA__AEO01554

SEQ ID NO: 68638 - RNA, 1701 nt, Artificial Sequence; identical to SEQ ID NO: 63857
  derived and/or modified sequence opt1 from hemagglutinin__InfluenzaA__AEO01555

SEQ ID NO: 68639 - RNA, 1701 nt, Artificial Sequence; identical to SEQ ID NO: 63677
  derived and/or modified sequence opt1 from hemagglutinin__InfluenzaA__AEO01557

SEQ ID NO: 68640 - RNA, 1701 nt, Artificial Sequence; identical to SEQ ID NO: 63677
  derived and/or modified sequence opt1 from hemagglutinin__InfluenzaA__AEO01558

SEQ ID NO: 68641 - RNA, 1701 nt, Artificial Sequence
  derived and/or modified sequence opt1 from hemagglutinin__InfluenzaA__AEO01559
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcaggacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68642 - RNA, 1701 nt, Artificial Sequence; identical to SEQ ID NO: 63677
  derived and/or modified sequence opt1 from hemagglutinin__InfluenzaA__AEO01560

SEQ ID NO: 68643 - RNA, 1701 nt, Artificial Sequence; identical to SEQ ID NO: 63677
  derived and/or modified sequence opt1 from hemagglutinin__InfluenzaA__AEO01561

SEQ ID NO: 68644 - RNA, 1701 nt, Artificial Sequence; identical to SEQ ID NO: 63677
  derived and/or modified sequence opt1 from hemagglutinin__InfluenzaA__AEO01562

SEQ ID NO: 68645 - RNA, 1701 nt, Artificial Sequence; identical to SEQ ID NO: 63677
  derived and/or modified sequence opt1 from hemagglutinin__InfluenzaA__AEO01563

SEQ ID NO: 68646 - RNA, 1701 nt, Artificial Sequence; identical to SEQ ID NO: 63677
  derived and/or modified sequence opt1 from hemagglutinin__InfluenzaA__AEO01564

SEQ ID NO: 68647 - RNA, 1701 nt, Artificial Sequence; identical to SEQ ID NO: 63677
  derived and/or modified sequence opt1 from hemagglutinin__InfluenzaA__AEO01565

SEQ ID NO: 68648 - RNA, 1701 nt, Artificial Sequence; identical to SEQ ID NO: 63664
  derived and/or modified sequence opt1 from hemagglutinin__InfluenzaA__AEO01566

SEQ ID NO: 68649 - RNA, 1701 nt, Artificial Sequence; identical to SEQ ID NO: 63919
  derived and/or modified sequence opt1 from hemagglutinin__InfluenzaA__AEO01567

SEQ ID NO: 68650 - RNA, 1701 nt, Artificial Sequence; identical to SEQ ID NO: 63859
  derived and/or modified sequence opt1 from hemagglutinin__InfluenzaA__AEO01568

SEQ ID NO: 68651 - RNA, 1701 nt, Artificial Sequence; identical to SEQ ID NO: 63859
  derived and/or modified sequence opt1 from hemagglutinin__InfluenzaA__AEO01569

SEQ ID NO: 68652 - RNA, 1701 nt, Artificial Sequence; identical to SEQ ID NO: 63919
  derived and/or modified sequence opt1 from hemagglutinin__InfluenzaA__AEO01570

SEQ ID NO: 68653 - RNA, 1701 nt, Artificial Sequence; identical to SEQ ID NO: 63859
  derived and/or modified sequence opt1 from hemagglutinin__InfluenzaA__AEO01571

SEQ ID NO: 68654 - RNA, 1701 nt, Artificial Sequence; identical to SEQ ID NO: 63919
  derived and/or modified sequence opt1 from hemagglutinin__InfluenzaA__AEO01572

SEQ ID NO: 68655 - RNA, 1701 nt, Artificial Sequence; identical to SEQ ID NO: 63664
  derived and/or modified sequence opt1 from hemagglutinin__InfluenzaA__AEO01573

SEQ ID NO: 68656 - RNA, 1701 nt, Artificial Sequence; identical to SEQ ID NO: 63677
  derived and/or modified sequence opt1 from hemagglutinin__InfluenzaA__AEO01574

SEQ ID NO: 68657 - RNA, 1701 nt, Artificial Sequence; identical to SEQ ID NO: 63664
  derived and/or modified sequence opt1 from hemagglutinin__InfluenzaA__AEO01575

SEQ ID NO: 68658 - RNA, 1701 nt, Artificial Sequence; identical to SEQ ID NO: 63664
  derived and/or modified sequence opt1 from hemagglutinin__InfluenzaA__AEO01576

SEQ ID NO: 68659 - RNA, 1701 nt, Artificial Sequence; identical to SEQ ID NO: 63664
  derived and/or modified sequence opt1 from hemagglutinin__InfluenzaA__AEO01577

SEQ ID NO: 68660 - RNA, 1701 nt, Artificial Sequence; identical to SEQ ID NO: 63919
  derived and/or modified sequence opt1 from hemagglutinin__InfluenzaA__AEO01578

SEQ ID NO: 68661 - RNA, 1701 nt, Artificial Sequence; identical to SEQ ID NO: 63919
  derived and/or modified sequence opt1 from hemagglutinin__InfluenzaA__AEO01579

SEQ ID NO: 68662 - RNA, 1701 nt, Artificial Sequence; identical to SEQ ID NO: 63664
  derived and/or modified sequence opt1 from hemagglutinin__InfluenzaA__AEO01581

SEQ ID NO: 68663 - RNA, 1701 nt, Artificial Sequence; identical to SEQ ID NO: 63664
  derived and/or modified sequence opt1 from hemagglutinin__InfluenzaA__AEO01582

SEQ ID NO: 68664 - RNA, 1701 nt, Artificial Sequence; identical to SEQ ID NO: 63664
  derived and/or modified sequence opt1 from hemagglutinin__InfluenzaA__AEO01583

SEQ ID NO: 68665 - RNA, 1701 nt, Artificial Sequence; identical to SEQ ID NO: 63664
  derived and/or modified sequence opt1 from hemagglutinin__InfluenzaA__AEO01584

SEQ ID NO: 68666 - RNA, 1701 nt, Artificial Sequence; identical to SEQ ID NO: 63664
  derived and/or modified sequence opt1 from hemagglutinin__InfluenzaA__AEO01585

SEQ ID NO: 68667 - RNA, 1701 nt, Artificial Sequence; identical to SEQ ID NO: 63664
  derived and/or modified sequence opt1 from hemagglutinin__InfluenzaA__AEO01586

SEQ ID NO: 68668 - RNA, 1701 nt, Artificial Sequence; identical to SEQ ID NO: 63664
  derived and/or modified sequence opt1 from hemagglutinin__InfluenzaA__AEO01587

SEQ ID NO: 68669 - RNA, 1701 nt, Artificial Sequence; identical to SEQ ID NO: 63664
  derived and/or modified sequence opt1 from hemagglutinin__InfluenzaA__AEO01588

SEQ ID NO: 68670 - RNA, 1701 nt, Artificial Sequence; identical to SEQ ID NO: 63677
  derived and/or modified sequence opt1 from hemagglutinin__InfluenzaA__AEO01589

SEQ ID NO: 68671 - RNA, 1701 nt, Artificial Sequence; identical to SEQ ID NO: 63677
  derived and/or modified sequence opt1 from hemagglutinin__InfluenzaA__AEO01590

SEQ ID NO: 68672 - RNA, 1701 nt, Artificial Sequence; identical to SEQ ID NO: 63677
  derived and/or modified sequence opt1 from hemagglutinin__InfluenzaA__AEO01591

SEQ ID NO: 68673 - RNA, 1701 nt, Artificial Sequence; identical to SEQ ID NO: 63664
  derived and/or modified sequence opt1 from hemagglutinin__InfluenzaA__AEO01592

SEQ ID NO: 68674 - RNA, 1701 nt, Artificial Sequence; identical to SEQ ID NO: 63677
  derived and/or modified sequence opt1 from hemagglutinin__InfluenzaA__AEO01593

SEQ ID NO: 68675 - RNA, 1701 nt, Artificial Sequence; identical to SEQ ID NO: 63664
  derived and/or modified sequence opt1 from hemagglutinin__InfluenzaA__AEO01594

SEQ ID NO: 68676 - RNA, 1701 nt, Artificial Sequence; identical to SEQ ID NO: 63664
  derived and/or modified sequence opt1 from hemagglutinin__InfluenzaA__AEO01595

SEQ ID NO: 68677 - RNA, 1701 nt, Artificial Sequence; identical to SEQ ID NO: 63857
  derived and/or modified sequence opt1 from hemagglutinin__InfluenzaA__AEO01596

SEQ ID NO: 68678 - RNA, 1701 nt, Artificial Sequence; identical to SEQ ID NO: 63677
  derived and/or modified sequence opt1 from hemagglutinin__InfluenzaA__AEO01597

SEQ ID NO: 68679 - RNA, 1701 nt, Artificial Sequence
  derived and/or modified sequence opt1 from hemagglutinin__InfluenzaA__AEO01598
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaacggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68680 - RNA, 1701 nt, Artificial Sequence; identical to SEQ ID NO: 63677
  derived and/or modified sequence opt1 from hemagglutinin__InfluenzaA__AEO01599

SEQ ID NO: 68681 - RNA, 1701 nt, Artificial Sequence; identical to SEQ ID NO: 63677
  derived and/or modified sequence opt1 from hemagglutinin__InfluenzaA__AEO01600

SEQ ID NO: 68682 - RNA, 1701 nt, Artificial Sequence; identical to SEQ ID NO: 63677
  derived and/or modified sequence opt1 from hemagglutinin__InfluenzaA__AEO01601

SEQ ID NO: 68683 - RNA, 1701 nt, Artificial Sequence; identical to SEQ ID NO: 63677
  derived and/or modified sequence opt1 from hemagglutinin__InfluenzaA__AEO01602

SEQ ID NO: 68684 - RNA, 1701 nt, Artificial Sequence; identical to SEQ ID NO: 63677
  derived and/or modified sequence opt1 from hemagglutinin__InfluenzaA__AEO01603

SEQ ID NO: 68685 - RNA, 1701 nt, Artificial Sequence; identical to SEQ ID NO: 63677
  derived and/or modified sequence opt1 from hemagglutinin__InfluenzaA__AEO01604

SEQ ID NO: 68686 - RNA, 1701 nt, Artificial Sequence; identical to SEQ ID NO: 63677
  derived and/or modified sequence opt1 from hemagglutinin__InfluenzaA__AEO01605

SEQ ID NO: 68687 - RNA, 1701 nt, Artificial Sequence
  derived and/or modified sequence opt1 from hemagglutinin__InfluenzaA__AEO01606
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68688 - RNA, 1701 nt, Artificial Sequence; identical to SEQ ID NO: 63919
  derived and/or modified sequence opt1 from hemagglutinin__InfluenzaA__AEO01607

SEQ ID NO: 68689 - RNA, 1701 nt, Artificial Sequence; identical to SEQ ID NO: 66582
  derived and/or modified sequence opt1 from hemagglutinin__InfluenzaA__AEO01608

SEQ ID NO: 68690 - RNA, 1701 nt, Artificial Sequence; identical to SEQ ID NO: 68442
  derived and/or modified sequence opt1 from hemagglutinin__InfluenzaA__AEO01609

SEQ ID NO: 68691 - RNA, 1701 nt, Artificial Sequence
  derived and/or modified sequence opt1 from hemagglutinin__InfluenzaA__AEO01610
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagcacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccgggugugcaucuga

SEQ ID NO: 68692 - RNA, 1701 nt, Artificial Sequence
  derived and/or modified sequence opt1 from hemagglutinin__InfluenzaA__AEO01611
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggccgggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucggggagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgccgccagcagccugguccucguggugucccugggggccaucagcuucuggaugugcuccaacggcagccugcagugccgcaucugcaucuga

SEQ ID NO: 68693 - RNA, 1701 nt, Artificial Sequence
  derived and/or modified sequence opt1 from hemagglutinin__InfluenzaA__AEO01612
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggccaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 68694 - RNA, 1701 nt, Artificial Sequence; identical to SEQ ID NO: 66274
  derived and/or modified sequence opt1 from hemagglutinin__InfluenzaA__AEO01613

SEQ ID NO: 68695 - RNA, 1701 nt, Artificial Sequence
  derived and/or modified sequence opt1 from hemagglutinin__InfluenzaA__AEO01614
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacaucccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 68696 - RNA, 1701 nt, Artificial Sequence
  derived and/or modified sequence opt1 from hemagglutinin__InfluenzaA__AEO01615
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaaguacuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68697 - RNA, 1701 nt, Artificial Sequence; identical to SEQ ID NO: 64030
  derived and/or modified sequence opt1 from hemagglutinin__InfluenzaA__AEO01616

SEQ ID NO: 68698 - RNA, 1701 nt, Artificial Sequence; identical to SEQ ID NO: 64841
  derived and/or modified sequence opt1 from hemagglutinin__InfluenzaA__AEO01617

SEQ ID NO: 68699 - RNA, 1701 nt, Artificial Sequence; identical to SEQ ID NO: 65274
  derived and/or modified sequence opt1 from hemagglutinin__InfluenzaA__AEO01619

SEQ ID NO: 68700 - RNA, 1701 nt, Artificial Sequence; identical to SEQ ID NO: 68386
  derived and/or modified sequence opt1 from hemagglutinin__InfluenzaA__AEO01620

SEQ ID NO: 68701 - RNA, 1701 nt, Artificial Sequence; identical to SEQ ID NO: 68533
  derived and/or modified sequence opt1 from hemagglutinin__InfluenzaA__AEO01621

SEQ ID NO: 68702 - RNA, 1701 nt, Artificial Sequence
  derived and/or modified sequence opt1 from hemagglutinin__InfluenzaA__AEO01625
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggagccucguggccuccagcggcacgcuggaguucaacaacgaguccuucaacuggaccggggugacccagaacggcaccagcuccgccugcauccgccggagcaacaacuccuucuucagccgccugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccagcgggcggaucaccgugagcacgaagcgcucccagcagaccgucaucccgaacaucggcagccggccccgcgugcggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcuggcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgagguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 68703 - RNA, 1701 nt, Artificial Sequence
  derived and/or modified sequence opt1 from hemagglutinin__InfluenzaA__AEO01636
augaaguccaucaucgcccuguccuacauccucugccuggugagcgcccagaagcugcccggcaacgacaacuccaccgcgacccucugccuggggcaccacgccgucccgaacggcacgaucgugaagaccaucaccaacgaccagaucgaggugaccaacgccacggagcugguccagagcuccagcaccggggagaucugcgacagcccccaccaggugcucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacccuggaguucaacaacgagagcuucaacuggacgggggugacccagaacggcaccuccagcgccugcauccgccgguccaacaacagcuucuucucccgccugaacuggcucacccacagcaaguucaaguaccccgcccugaacgucacgaugcccaacaacgaggaguucgacaagcuguacaucuggggcgugcaccaccccgggaccgacaacgaccagaucuuccucuacgcgcaggccagcgggcggaucaccguguccaccaagcgcagccagcagacggucaucccgaacaucggcucccggccccgcgugcggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgucaaccgcaucacguacggggccugcccccgguacgugaagcagaacacccugaagcuggcgaccggcaugcgcaacgugcccgagaagcagacccgggggaucuucggcgccaucgccggguucaucgagaacggcugggagggcauggucgacgggugguacggcuuccgccaccagaacuccgaggggaucggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 68704 - RNA, 1701 nt, Artificial Sequence
  derived and/or modified sequence opt1 from hemagglutinin__InfluenzaA__AEO01642
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcaacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccaagugcaucacgcccaacggcagcauccccaacgacaagccguuccagaacgugaaccgcgucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 68705 - RNA, 1698 nt, Artificial Sequence
  derived and/or modified sequence opt1 from hemagglutinin__InfluenzaA__AEO01663
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugcgggccccgcgcuacgccuucgcccucucccggggguucggcagcggcaucaucaacuccaacgcgcccauggacaagugcgacgccaagugccagacgccccagggggccaucaacagcucccugcccuuccagaacguccacccggugcccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuucaucgacaucuggaccuacaacgcggagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuacccgaaguacuccgaggagagcaagcugaaccgggagaagaucgacggcgugcgccucgaguccaugggcgucuaccagauccuggccaucuacagcacgguggccagcucccuggugcuccuggucagccugggggccaucuccuucuggaugugcagcaacggcucccuccagugccggaucugcaucuga

SEQ ID NO: 68706 - RNA, 1698 nt, Artificial Sequence
  derived and/or modified sequence opt1 from hemagglutinin__InfluenzaA__AEO01674
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacgagaaccugaaggccccgcgguacgccuucgcccucucccgcggcuucgggagcggcaucaucaacuccaaggcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugcggcucgaguccaugggcgucuaccagauccuggccaucuacagcaccguggccagcucccuggugcuccuggucagccugggcgccaucuccuucuggaugugcagcaacgggucccuccagugccgcaucugcaucuga

SEQ ID NO: 68707 - RNA, 1701 nt, Artificial Sequence; identical to SEQ ID NO: 68702
  derived and/or modified sequence opt1 from hemagglutinin__InfluenzaA__AEO01691

SEQ ID NO: 68708 - RNA, 1698 nt, Artificial Sequence
  derived and/or modified sequence opt1 from hemagglutinin__InfluenzaA__AEO01699
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagccccgggacaccaucaucuucgaggcgaacgggaaccugaucgccccgcgcuacgccuucgcccucucccggggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccccagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuacccgaaguacuccgaggagagcaagcugaaccgggagaagaucgacggggugaagcucgaguccaugggcgccuaccagauccuggccaucuacagcaccggcgccagcucccugguccuccuggugagccugggggccaucuccuucuggaugugcagcaacggcucccuccagcgccggaucugcaucuga

SEQ ID NO: 68709 - RNA, 1698 nt, Artificial Sequence
  derived and/or modified sequence opt1 from hemagglutinin__InfluenzaA__AEO01709
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaagcuccgggaccaggacggccgcaucaacuacuacuggacccugcuggagcccggggacaccaccaucuucgaggcgaacggcaaccucaucgccccgcgguacgccuucgcccugucccgcggguucggcagcggcaucaucaacuccaacgcccccauggacaagugcgacgcgaagugccagacgccccagggggccaucaacagcucccugcccuuccagaacgugcacccggucaccaucggcgagugccccaaguacgugcggagcgccaagcuccgcauggugaccgggcugcggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcucgagcggcgcauggagaaccugaacaagaagguggacgacggcuucaucgacaucuggacguacaacgccgagcugcucguccugcuggagaacgagcggacccucgacuuccacgacagcaacgugaagaaccuguacgagaaggugaagucccagcugaagaacaacgcgaaggagaucgggaacggcugcuucgagcucuaccugaagugcaacggggagugcauggagagcgucaagaacggcaccuacgacuaccccaaguacuccgaggagagcaagcugaaccgcgagaagaucgacggcgugaagcucgaguccauggggguguaccagauccuggccaucuacagcaccgucgccagcucccuggugcuccuggugagccugggcgccaucuccuucuggaugugcagcaacgggucccugcagugccggaucugcaucuga

SEQ ID NO: 68710 - RNA, 1701 nt, Artificial Sequence; identical to SEQ ID NO: 64841
  derived and/or modified sequence opt1 from hemagglutinin__InfluenzaA__AEO37530

SEQ ID NO: 68711 - RNA, 1701 nt, Artificial Sequence
  derived and/or modified sequence opt1 from hemagglutinin__InfluenzaA__AEO72176
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucgccgugagccugggggccaucagcuucuggaugugcuccaacggcagccugcagugccggaucugcaucuga

SEQ ID NO: 68712 - RNA, 1704 nt, Artificial Sequence
  derived and/or modified sequence opt1 from hemagglutinin__InfluenzaA__AEO88980
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggagcaaggugaacgggcaguccggccgcauggacuucuucuggaccauccucaagcccaacgacgcgaucaacuucgagagcaacgggaacuucaucgcccccgaguacgccuacaagaucgucaagaagggcgacagcgccaucaugaaguccgagguggaguacggcaacugcaacaccaagugccagaccccgaucggggccaucaacagcuccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcacguaccagauccuguccaucuacagcaccgucgcguccagccucgcccuggccaucaugguggccgggcugucccucuggaugugcagcaacggcagccugcagugccgcaucugcaucuga

SEQ ID NO: 68713 - RNA, 1704 nt, Artificial Sequence
  derived and/or modified sequence opt1 from hemagglutinin__InfluenzaA__AEO89021
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagaucccgaucauccccaagagcuccuggagcgaccacgaggccuccagcggcgucuccagcgcgugccccuaccagggcacccccuccuucuuccgcaacgugguguggcugaucaagaagaacaacacguacccgaccaucaagcggagcuacaacaacaccaaccaggaggaccuccugauccugugggggauccaccacuccaacaacgccgccgagcagaccaagcucuaccagaaccccacgaccuacaucagcgucggcaccuccacccugaaccugcgccucgugcccaagaucgccacgcggagcaaggugaacgggcaguccggccgcauggacuucuucuggaccauccugaagcccaacgacgcgaucaacuucgagagcaacgggaacuucaucgccccggaguacgccuacaagaucgucaagaagggcgacagcgccaucaugaaguccgagguggaguacggcaacugcaacaccaagugccagacccccaucggggccaucaacagcuccaugcccuuccacaacauccacccccugacgaucggcgagugcccgaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacagcaacgugaagaaccucuacgacaagguccggcugcagcugcgcgacaacgccaaggagcucgggaacggcugcuucgaguucuaccacaagugcgacaacgagugcauggaguccgugcggaacggcaccuacgacuacccccaguacagcgaggaggcccgccugaagcgggaggagaucuccggggugaagcuggagagcaucggcacguaccagauccucuccaucuacagcaccgucgcguccagccuggcccuggccaucaugguggccgggcucucccuguggaugugcagcaacggcagccugcagugccgcaucugcaucuga

SEQ ID NO: 68714 - RNA, 1704 nt, Artificial Sequence
  derived and/or modified sequence opt1 from hemagglutinin__InfluenzaA__AEO89030
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgugugcccguaccagggcacccccuccuucuuccgcaacguggucuggcugaucaagaagaacaacacguaccccaccaucaagcggagcuacaacaacaccaaccaggaggaccuccugauccugugggggauccaccacuccaacgacgcggccgagcagaccaagcucuaccagaacccgacgaccuacaucagcgugggcaccuccacccugaaccagcgccuggugcccaagaucgccacgcggagcaaggucaacgggcaguccggccgcauggacuucuucuggaccgugcucaagcccaacgacgccaucaacuucgagagcaacgggaacuucaucgcgcccgaguacgccuacaagaucgugaagaagggcgacagcgccaucaugaaguccgaggucgaguacggcaacugcaacaccaagugccagaccccgaucggggccaucaacagcuccaugcccuuccacaacauccacccccugacgaucggcgagugccccaaguacgucaagagcaacaagcuggugcucgccaccgggcugcggaacuccccgcugcgcgagcggcgccggaagcgcggccucuucggcgcgaucgccggguucaucgagggcggguggcagggcaugguggacgggugguacggcuaccaccacagcaacgagcagggcuccggguacgccgccgacaaggagagcacccagaaggccaucgacggcgugaccaacaaggugaacuccaucaucgacaagaugaacacgcaguucgaggcggucgggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaaggugcggcuccagcugcgcgacaacgccaaggagcuggggaacggcugcuucgaguucuaccacaagugcgacaacgagugcauggaguccguccggaacggcaccuacgacuacccccaguacagcgaggaggcccgccucaagcgggaggagaucuccggggugaagcuggagagcaucggcacguaccagauccuguccaucuacagcaccguggccuccagccucgcgcuggccaucauggucgccgggcugucccucuggaugugcagcaacggcagccugcagugccgcaucugcaucuga

SEQ ID NO: 68715 - RNA, 1704 nt, Artificial Sequence
  derived and/or modified sequence opt1 from hemagglutinin__InfluenzaA__AEO89048
auggagaagaucguguuccugcucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugaucuggcugaucaagaagaacaacacguaccccaccaucaagcggagcuacaacaacaccaaccaggaggaccugcucauccugugggggauccaccacuccaacgacgccgccgagcagaccaagcuguaccagaacccgacgaccuacaucagcgugggcaccuccacccucaaccagcgccugguccccaagaucgccacgcggagcaaggugaacgggcaguccggccgcauggacuucuucuggaccauccugaagcccaacgacgcgaucaacuucgagagcaacgggaacuucaucgcccccgaguacgccuacaagaucgugaagaagggcgacagcgccauccucaaguccgaggucgaguacggcaacugcaacaccaagugccagaccccgaucggggccaucaacagcuccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggugaacuccaucaucgacaagaugaacacgcaguucgaggccgucgggcgggaguucaacaaccuggagcgccggaucgagaaccugaacaagaagauggaggacggcuuccucgacguguggaccuacaacgccgagcugcuggugcucauggagaacgagcgcacccuggacuuccacgacagcaacgucaagaaccuguacgacaaggugcggcuccagcugcgcgacaacgccaaggagcuggggaacggcugcuucgaguucuaccacaagugcgacaacgagugcauggaguccguccggaacggcaccuacgacuacccccaguacagcgaggaggcccgccucaagcgggaggagaucuccggggugaagcuggagagcaucggcacguaccagauccuguccaucuacagcaccguggcguccagccucgcccuggccaucauggucgccgggcugucccucuggaugugcagcaacggcagccugcagugccgcaucugcaucuga

SEQ ID NO: 68716 - RNA, 1704 nt, Artificial Sequence
  derived and/or modified sequence opt1 from hemagglutinin__InfluenzaA__AEO89065
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgugugcccguaccagggcacccccuccuucuuccgcaacguggucuggcugaucaagaagaacaacacguaccccaccaucaagcggagcuacaacaacaccaaccaggaggaccuccugauccugugggggauccaccacuccaacgacgcggccgagcagaccaagcucuaccagaacccgacgaccuacaucagcgugggcaccuccacccugaaccugcgccucgugcccaagaucgccacgcggagcaaggucaacgggcaguccggccgcauggacuucuucuggaccauccugaagcccagcgacgccaucaacuucgagagcaacgggaacuucaucgcgcccgaguacgccuacaagaucgugaagaagggcgacuccgccaucaugaaguccgagguggaguacggcaacugcaacaccaagugccagaccccgaucggggccaucaacagcagcaugcccuuccacaacauccacccccugacgaucggcgagugccccaaguacgucaaguccaacaagcucgugcuggccaccgggcugcggaacagcccgcuccgcgagcggcgccggaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggcgguggggcgggaguucaacaaccuggagcgccggaucgagaaccucaacaagaagauggaggacggcuuccuggacgucuggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcgugcggaacggcaccuacgacuacccccaguacuccgaggaggcccgccugaagcgggaggagaucagcggggucaagcuggaguccaucggcacguaccagauccucagcaucuacuccaccguggccagcucccuggcgcuggccaucaugguggccgggcucagccuguggaugugcagcaacggcucccugcagugccgcaucugcaucuga

SEQ ID NO: 68717 - RNA, 1704 nt, Artificial Sequence
  derived and/or modified sequence opt1 from hemagglutinin__InfluenzaA__AEO89082
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgacaccuccagcggcgucuccagcgccugcccguaccagggcacgcccuccuucuuccgcaacgugguguggcugaucaagaagaacaacaccuaccccaccaucaagcggagcuacaacaacaccaacaaggaggaccuccugauccugugggggauccaccacuccaacgacgcggccgagcagacgaagcucuaccagaacccgaccaccuacaucagcgucggcaccuccacgcugaaccagcgccuggugcccaagaucgccacccggagcaaggugaacgggcaguccggccgcauggacuucuucuggaccauccucaagcccaacgacgccaucaacuucgagagcaacgggaacuucaucgcgcccgaguacgccuacaagaucgucaagaagggcgacagcgccaucaugaaguccgagguggaguacggcaacugcaacaccaagugccagacgccgaucggggccaucaacagcuccaugcccuuccacaacauccacccccugaccaucggcgagugccccaaguacgucaagagcaacaagcuggugcucgccaccgggcugcggaacuccccgcugcgcgagcggcgccggaagcgcggccucuucggcgcgaucgccggguucaucgagggcggguggcagggcaugguggacgggugguacggcuaccaccacagcaacgagcagggcuccggguacgccgccgacaaggagagcacccagaaggccaucgacggcgugacgaacaaggucaacuccaucaucgacaagaugaacacccaguucgaggcgguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcacguacgacuacccccaguacagcgaggaggcccgccucaagcgggaggagaucuccggggugaagcuggagagcaucggcaccuaccagauccuguccaucuacagcaccgucgccuccagccucgcgcuggccaucaugguggccgggcugucccucuggaugugcagcaacggcagccugcagugccgcaucugcaucuga

SEQ ID NO: 68718 - RNA, 1704 nt, Artificial Sequence
  derived and/or modified sequence opt1 from hemagglutinin__InfluenzaA__AEO89091
auggagaagaccguguuccugcucgccaucgucagccuggugaaguccgaccagaucugcaucggcuaccacgccaacaacagcaccgagcaggucgacacgaucauggagaagaacgugaccgugacccacgcgcagaacauccuggagaagacccacaacgggaagcucugcgacaucgacggcgugaagccccugauccugaaggacugcuccgucgccggguggcuccugggcaacccgaugugcgacgaguucaucaacgugcccgaguggagcuacaucguggagaaggccaaccccgccaacgaccugugcuaccccgggaacuucaacgacuacgaggagcucaagcaccuccugucccgcaucaaccacuucgagaagauccagaucauccccaagagcuccuggagcgaccacgaggccuccagcggcgucuccagcacgugcccguaccagggcacccccuccuucuuccggaacgugguguggcugaucaagaagaacaacaccuaccccaccaucaagcgcagcuacaacaacacgaaccaggaggaccugcugauccucugggggauccaccacuccaacgacgaggcggagcaggccaagcuguaccagaacccgaccaccuacaucagcgucggcaccuccacgcugaaccagcggcucgugcccaagaucgccacccgcagcaaggugaacgggcaguccggccggauggacuucuucuggaccauccugaagcccaacgacgccaucaacuucgagagcaacgggaacuucaucgcgcccgaguacgccuacaagaucgucaagaagggcgacagcgccaucaugaaguccgagguggaguacggcaacugcaacaccaagugccagacgccgaucggggccaucaacagcuccaugcccuuccacaacauccacccccugaccaucggcgagugccccaaguacgucaagagcaacaagcucgugcuggccaccgggcugcgcaacuccccgcuccgggagcgccggcgcaagcggggccuguucggcgcgaucgccggguucaucgagggcggguggcagggcaugguggacgggugguacggcuaccaccacagcaacgagcagggcuccggguacgccgccgacaaggagagcacccagaaggccaucgacggcgugacgaacaaggucaacuccaucaucgacaagaugaacacccaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccacaagugcgacgacgagugcauggaguccgugcgcaacggcacguacgacuacccccaguacagcgaggaggcccggcugaagcgcgaggagaucuccggggugaagcuggagagcaucggcaccuaccagauccucuccaucuacagcaccgucgccuccagccuggcgcuggccaucaugauggccgggcucucccuguggaugugcagcaacggcagccugcagugccggaucugcaucuga

SEQ ID NO: 68719 - RNA, 1704 nt, Artificial Sequence
  derived and/or modified sequence opt1 from hemagglutinin__InfluenzaA__AEO89100
auggagaagaucgugcccuuccuggccaucaucagccucgucaaguccgaccagaucugcaucggcuaccacgccaacaacagcaccgagcaggucgacaccaucauggagaagaacgugacggugacccacgcgcaggacauccuggagaagacccacaacgggaagcugugcgaccucgacggcgugaagccgcugauccugcgcgacugcuccguggccggguggcuccugggcaaccccaugugcgacgaguucaucaacguccccgaguggagcuacaucguggagaaggccaaccccgccaacgaccugugcuacccggggaacuucaacgacuacgaggagcucaagcaccuccugucccggaucaaccacuucgagaagauccagaucauccccaagaacagcugguccgaccacgaggccagcuccggcgugagcuccgcgugccccuaccagggcacccccagcuucuuccgcaacgucguguggcugaucaagaagaacaacacguacccgaccaucaagcgguccuacaacaacaccaaccaggaggaccugcugauccucugggggauccaccacagcaacgacgccgccgagcagaccaagcuguaccagaaccccacgaccuacaucuccgugggcaccagcacccugaaccagcgccucguccccaagaucgccacgcgguccaaggugaacgggcagagcggccgcauggacuucuucuggaccauccugaagcccaacgacgcgaucaacuucgaguccaacgggaacuucaucgccccggaguacgccuacaagaucgugaagaagggcgacagcgccaucaugaaguccgaggucgaguacggcaacugcaacaccaagugccagacccccaucggggccaucaacagcagcaugcccuuccacaacauccacccccugacgaucggcgagugcccgaaguacgugaaguccaacaagcucgugcuggcgaccgggcugcggaacagcccccuccgcgagcggcgccggaagcgcggccuguucggcgccaucgccggguucaucgagggcggguggcagggcauggucgacgggugguacggcuuccaccacuccaacgagcagggcagcggguacgccgccgacaaggaguccacccagaaggcgaucgacggcgugaccaacaaggugaacagcaucaucgacaagaugaacacgcaguucgaggccgucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacgacgagugcauggagagcgucaagaacggcaccuacgacuacccccaguacuccgaggaggcccggcugaagcgcgaggagaucagcggggugaagcuggaguccaucggcacguaccagauccucagcaucuacuccaccguggcgagcucccuggcccuggccaucauggucgccgggcucagccuguggaugugcuccaacggcagccugcagugccggaucugcaucuga

SEQ ID NO: 68720 - RNA, 1704 nt, Artificial Sequence
  derived and/or modified sequence opt1 from hemagglutinin__InfluenzaA__AEO89109
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacaucagcgucggcaccuccacccugaaccagcgccuggugaccaagaucgccacgcggcccaaggugaacgggcagagcggccgcauggacuucuucuggaccauccucaagcccaacgacgcgaucaacuucgaguccaacgggaacuucaucgcccccgaguacgccuacaagaucgucaaggagggcgacagcgccaucaugaaguccgagguggaguacggcaacugcaacaccaagugccagaccccgaucggggccaucaacagcagcaugcccuuccacaacauccacccccugacgaucggcgagugccccaaguacgugaaguccaacaagcugguccucgcgaccgggcugcggaacagcccgcugcgcgagcggcgccggaagcgcggccucuucggcgccaucgccggguucaucgagggcggguggcagggcaugguggacgggugguacggcuaccaccacuccaacgagcagggcagcggguacgccgccgacaaggaguccacccagaaggcgaucgacggcgugaccaacaaggucaacagcaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacuccaacgugaagaaccuguacgacaagguccggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgggaggagaucagcggggugaagcuggaguccaucggcacguaccagauccugagcaucuacuccaccgucgcgagcucccucgcccuggccaucaugguggccgggcugagccucuggaugugcuccaacggcagccugcagugccgcaucugcaucuga

SEQ ID NO: 68721 - RNA, 1704 nt, Artificial Sequence
  derived and/or modified sequence opt1 from hemagglutinin__InfluenzaA__AEO89127
auggagaagaucgugcugcuccuggccaucaucagccuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcguguccagcgcgugcccguaccagggcacccccuccuucuuccgcaacgucguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacaucagcgugggcaccuccacccugaaccagcgccugguccccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgugaaggagggcgacagcgccaucaugaaguccgaggucgaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggcgccggggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggugaacuccaucaucgacaagaugaacacccaguucgaggccgucgggcgcgaguucaacaaccuggagcggcgcaucgagaaccugaacaagaagauggaggacggcuuccucgacguguggacguacaacgccgagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccguccgcaacggcaccuacgacuacccccaguacagcgaggaggcccggcucaagcgcgaggagaucuccgggaucaagcuggagagcaugggcaccuaccagauccuguccaucuacagcacgguggcguccagccucgcccuggccaucaugguggccgggcugucccucuggaugugcagcaacggcagccugcagugccgcaucugcaucuga

SEQ ID NO: 68722 - RNA, 1704 nt, Artificial Sequence
  derived and/or modified sequence opt1 from hemagglutinin__InfluenzaA__AEO89145
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugggggacugcuccgucgccggcuggcugcucgggaacccgaugugcgacaaguucaucaacgugcccgaguggagcuacaucguggagaaggccaaccccgccaacgaccugugcuaccccggcaacuucaacgacuacgaggagcugaagcaccuccugucccgcaucaaccacuucgagaagauccagaucauccccaagagcuccuggagcgaccacgaggccuccagcggcgucuccagcgcgugcccguaccaggggacccccuccuucuuccggaacgugguguggcugacgaagaagaacaacaccuaccccaccaucaagcgcagcuacaacaacaccaaccaggaggaccuccugauccuguggggcauccaccacuccaacaacgccgccgagcaggagaagcucuaccagaacccgacgaccuacaucagcgucgggaccuccacccugaaccagcggcuggugcccaagaucgccacgcgcagcaaggugaacggccaguccgggcggauggacuucuucuggaccauccucaagcccaacgacgcgaucaacuucgagagcaacggcaacuucaucgcccccgaguacgccuacaagaucgucaagaagggcgacagcgccaucaugaaguccgggguggaguacggcaacugcaacaccaagugccagaccccgaucggggccaucaacagcuccaugcccuuccacaacauccacccccugacgaucggcgagugccccaaguacgucaagagcaacaagcuggugcucgcgaccggccugcgcaacuccccgcugcgggagcgccggcgcaagcggggccucuucggggccaucgccggguucaucgagggcggguggcagggcaugguggacggcugguacggguaccaccacagcaacgagcagggcuccggguacgccgccgacaaggagagcacccagaaggcgaucgacggcgugaccaacaaggucaacuccaucaucgacaagaugaacacgcaguucgaggccguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacagcaacgugaagaaccuguacgacaagguccgccuccagcugcgggacaacgccaaggagcugggcaacgggugcuucgaguucuaccacaagugcgacaacgagugcauggaguccgugcgcaacggcaccuacgacuacccccaguacagcgaggaggcccggcucaagcgcgaggagaucuccggggugaagcuggagagcaucggcacguaccagauccuguccaucuacagcaccgcggccuccagccucgcccuggccaucauggucgccgggcugucccucuggaugugcagcaacggcagccugcagugccggaucugcaucuga

SEQ ID NO: 68723 - RNA, 1707 nt, Artificial Sequence
  derived and/or modified sequence opt1 from hemagglutinin__InfluenzaA__AEO89163
auggagaagaucgugcugcuguucgccaucgucagccuggugaaguccgaccacaucugcaucggcuaccacgccaacaacagcaccgagcaggucgacaccaucauggagaagaacgugacggugacccacgcgcaggacauccuggagaagacccacaacgggaagcucugcgaccugaacggcgugaagccccugauccucaaggacugcuccgucgccggguggcugcugggcaacccgaugugcgacgaguucaucgacgugcccgaguggagcuacaucguggagaaggccaaccccgccaacgaccucugcuaccccgggaacuucaacgacuacgaggagcugaagcaccuccucucccgcaucaaccacuucgagaagauccagaucaucccgaaggacagcuggcccgaccacgaggccucccugggcgucagcuccgcgugccccuaccagggcaacagcuccuucuuccggaacgugguguggcugaucaagaaggggaacgccuaccccaccaucaagaaguccuacaacaacacgaacaaggaggaccuccugauccuguggggcauccaccacccgaacgacgaggccgagcagacccgccucuaccagaaccccaccaccuacaucagcaucgggacgagcacccugaaccagcggcuggucccccgcaucgccacccgguccaaggugaacggccagagcgggcgcaucgacuucuucuggaccauccucaagcccaacgacgcgaucaacuucgaguccaacggcaacuucaucgccccggaguacgccuacaagaucgugaagaagggcgacagcacgaucaugaaguccgaggucgaguacgggaacugcaacacccggugccagacccccaugggcgccaucaacagcagcaugcccuuccacaacauccacccccugaccaucggggagugcccgaaguacgugaaguccaacaagcuggugcucgccacgggccugcgcaacagcccccagcgggagcgccggcgccggaagcgcggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacagcaucaucgacaagaugaacacccaguucgaggcggucggccgggaguucaacaaccucgagcgccggaucgagaaccugaacaagaagauggaggacggguuccuggacguguggacguacaacgccgagcuccuggugcugauggagaacgagcgcacccucgacuuccacgacuccaacgucaagaaccuguacgacaaggugcggcugcagcuccgcgacaacgccaaggagcugggcaacggcugcuucgaguucuaccacaagugcgacaacgagugcauggagagcguccggaacgggaccuacgacuacccccaguacuccgaggaggcccgccugaagcgcgaggagaucagcggcgugaagcucgaguccaucgggaccuaccagauccugagcaucuacuccacgguggccagcucccugguccucgcgaucaugguggccggccugagccuguggaugugcuccaacgggagccuccagugccggaucugcaucuga

SEQ ID NO: 68724 - RNA, 1704 nt, Artificial Sequence
  derived and/or modified sequence opt1 from hemagglutinin__InfluenzaA__AEO89172
auggagaagaucgugcugcuccuggccaucgucagccuggugcgcuccgaccagaucugcaucggcuaccacgccaacaacagcaccgagcaggucgacaccaucauggagaagaacgugacggugacccacgcgcagaacauccucgagaagacccacaacgggaagcugugcgaccuggacggcgugaagccccucauccugcgggacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccagcggcgucuccagcgcgugcccguaccagggcacccccuccuucuuccggaacgugguguggcugaucaagaagaacaacacguaccccaccaucaagcgcagcuacaacaacaccaaccaggaggaccuccugguccugugggggauccaccacuccaacgacgccaccgagcagaucaagcucuaccagaacccgacgaccuacgugagcgugggcaccuccacccugaaccagcggcugguccccaagaucgccacgcgcagcaaggugaacgggcaguccggccggauggacuucuucuggaccauccucaagagcaacgacgccaucaacuucgagagcaacgggaacuucaucgcgcccgaguacgccuacaagaucgugaagaagggcgacuccgccaucaugaaguccgaggucgaguacggcaacugcuccaccaagugccagacccccaucggggccaucaacagcuccaugccguuccacaacauccacccccugacgaucggcgagugccccaaguacgucaagagcaacaagcuggugcucgccaccgggcugcgcaacagcccccugcgggagcgccggcgcaagcggggccucuucggcgcgaucgccggguucaucgagggcggguggcagggcaugguggacgggugguacggcuaccaccacagcaacgagcagggcuccggguacgccgccgacaaggagagcacccagaaggccaucgacggcgugaccaacaaggugaacuccaucaucgacaagaugaacacgcaguucgaggcggucgggcgcgaguucaacaaccuggagcggcgcaucgagaaccugaacaagaagauggaggacggcuuccucgacguguggaccuacaacgccgagcugcugguccucauggagaacgagcggacccuggacuuccacgacagcaacgugaagaaccuguacgacaaggugcgccuccagcugcgggacaacgccaaggagcuggggaacggcugcuucgaguucuaccacaagugcgacaacgagugcauggaguccguccgcaacggcaccuacgacuacccgcaguacagcgaggaggcccggcucaagcgcgaggagaucuccggggugaagcuggagagcaucggcacguaccagauccuguccaucuacagcaccguggccuccagccucgcgcuggccaucauggucgccgggcugagccucuggaugugcuccaacggcagccugcagugccgcaucugcaucuga

SEQ ID NO: 68725 - RNA, 1704 nt, Artificial Sequence
  derived and/or modified sequence opt1 from hemagglutinin__InfluenzaA__AEO89181
auggagaagaucgugcugcuguucgccaccaucagccuggucaaguccgaccacaucugcaucggcuaccacgccaacaacagcaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgaccucugcuaccccgggaacuucaacgacuacgaggagcugaagcaccuccucucccgcaucaaccacuucgagaagauccagaucaucccgaagaacagcugguccgaccacgaggccagccugggcguguccgcggccugccccuaccagggcaagagcuccuucuuccggaacgucguguggcugaucaagaaggacaacgccuaccccacgaucaagaagggguacaacaacaccaaccaggaggaccuccuggugcuguggggcauccaccaccccaacgacgaggccgagcagacccgccucuaccagaacccgaccacguacaucagcaucgggaccuccacccugaaccagcggcugguccccaagaucgcgacccgcagcaagaucaacggccaguccgggcggaucgacuucuucuggacgauccucaagcccaacgacgccauccacuucgagagcaacggcaacuucaucgcccccgaguacgccuacaagaucgugaagaagggcgacuccaccaucaugaaguccgagguggaguacgggaacugcaacacccgcugccagaccccgaucggcgccaucaacagcagcaugcccuuccacaacauccacccccugacgaucggggagugccccaaguacgucaagagcaacaagcuggugcucgcgaccggccugcggaacuccccgcagcgcgagcggcgccggaagcgcggccuguucggggccaucgccggcuucaucgagggcggguggcaggggaugguggacggcugguacggcuaccaccacagcaacgagcagggguccggcuacgccgccgacaaggagagcacccagaaggcgaucgacggggucaccaacaaggugaacuccaucaucgacaagaugaacacgcaguucgaggccgugggccgggaguucaacaaccucgagcgccggaucgagaaccugaacaagaagauggaggacggguuccuggacgucuggaccuacaacgccgagcuccuggugcugauggagaacgagcgcacccucgacuuccacgacagcaacgugcggaaccuguacgacaagguccgccugcagcucaaggacaacgccaaggagcugggcaacggcugcuucgaguucuaccacaagugcgacaacgagugcauggaguccgugcggaacgggaccuacgacuacccccaguacagcgaggaggcccgccugaagcgggaggagaucuccggcgucaagcucgagagcaucgggaucuaccagauccuguccaucuacagcacgguggcguccagccuggugcucgccaucaugauggccggccugucccuguggaugugcagcaacgggucccuccagugccgcaucugcaucuga

SEQ ID NO: 68726 - RNA, 1704 nt, Artificial Sequence
  derived and/or modified sequence opt1 from hemagglutinin__InfluenzaA__AEO89192
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacgucagcaucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaaggagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuacccccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucaacggggugaagcuggaguccaucggcaccuaccagauccugagcaucuacuccacggucgcgagcucccucgcccuggccaucaugguggccgggcugagccucuggaugugcuccaacggcagccugcagugccgcaucugcaucuga

SEQ ID NO: 68727 - RNA, 1704 nt, Artificial Sequence
  derived and/or modified sequence opt1 from hemagglutinin__InfluenzaA__AEO89203
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacgucagcaucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaaggagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucaacggggugaagcuggaguccaucggcaccuaccagauccugagcaucuacuccacggucgcgagcucccucgcccuggccaucaugguggccgggcugagccucuggaugugcuccaacggcagccugcagugccgcaucugcaucuga

SEQ ID NO: 68728 - RNA, 1704 nt, Artificial Sequence; identical to SEQ ID NO: 68727
  derived and/or modified sequence opt1 from hemagglutinin__InfluenzaA__AEO89213

SEQ ID NO: 68729 - RNA, 1704 nt, Artificial Sequence; identical to SEQ ID NO: 68727
  derived and/or modified sequence opt1 from hemagglutinin__InfluenzaA__AEO89224

SEQ ID NO: 68730 - RNA, 1704 nt, Artificial Sequence
  derived and/or modified sequence opt1 from hemagglutinin__InfluenzaA__AEO89235
auggagaagaucgugcugcuccuggccauggucagccuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggagcuacaucguggagaaggccaaccccgccaacgaccugugcuaccccgggaaccugaacgacuacgaggagcucaagcaccuccugucccgcaucaaccacuucgagaagauccagaucauccccaagagcuccuggagcgaccacgaggccucccugggcgucagcuccgcgugcccguaccagggcacccccagcuucuuccggaacgugaucuggcugaucaagaagaacaacacguaccccaccaucaagcgcuccuacaacaacaccaaccaggaggaccugcucauccugugggggauccaccacagcaacgacgaggccgagcagaucaagcuguaccagaacccgaccacguacaucuccgugggcaccagcacccucaaccagcggcugguccccaagaucgccacccgcuccaaggugaacgggcagagcggccggauggacuucuucuggacgauccugaagcccgacgacgccaucaacuucgaguccaacgggaacuucaucgcgcccgaguacgccuacaagaucgugaagaagggcgacagcgccaucaugaaguccgaggucgaguacggcaacugcaacaccaagugccagaccccgaucggggccaucaacagcagcaugcccuuccacaacauccacccccucaccaucggcgagugccccaaguacgugaaguccaacaagcuggugcuggccacggggcuccgcaacagcccgcugcgggagaagcgccggaagcgcggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacccaguucgaggcggucgggcgggaguucaacaaccucgagcgccggaucgagaaccugaacaagaagauggaggacggcuuccuggacguguggacguacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagagcguccggaacggcaccuacgacuacccccaguacuccgaggaggcccgccugaagcgggaggagaucagcggggugaagcucgaguccaucggcaccuaccagauccugagcaucuacuccacgguggccagcucccuggcgcucgccaucauggucgccgggcugagccuguggaugugcuccaacggcagccuccagugccgcaucugcaucuga

SEQ ID NO: 68731 - RNA, 1704 nt, Artificial Sequence
  derived and/or modified sequence opt1 from hemagglutinin__InfluenzaA__AEO89246
auggagaagaucgugccccugcucgccauggucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccgcugauccuccgcgacugcuccgucgccggguggcugcugggcaaccccaugugcgacgaguucaucaacgugcccgaguggagcuacaucguggagaaggccaaccccgccaacgaccucugcuacccggggaaccugaacgacuacgaggagcugaagcaccuccugucccggaucaaccacuucgagaagauccagaucauccccaagagcuccuggagcgaccacgaggccucccugggcgucagcuccgcgugccccuaccagggcacccccagcuucuuccgcaacgugguguggcucaucaagaagaacaacacguacccgaccaucaagcgguccuacaacaacaccaaccaggaggaccugcugauccucugggggauccaccacagcaacgacgaggccgagcagaucaagcuguaccagaaccccaccacguacaucuccgucggcaccagcacccugaaccagcgccucgugcccaagaucgccacccgguccaaggugaacgggcagagcggccgcauggacuucuucuggacgauccugaagcccgacgacgccaucaacuucgaguccaacgggaacuucaucgcgccggaguacgccuacaagaucgucaagaagggcgacagcgccaucaugaaguccgagguggaguacggcaacugcaacaccaagugccagacccccaucggggccaucaacagcagcaugcccuuccacaacauccacccccugaccaucggcgagugcccgaaguacgugaaguccaacaagcucguccuggccacggggcugcggaacagcccccuccgcgagcggcgccggaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgugaccaacaaggucaacagcaucaucgacaagaugaacacccaguucgaggcgguggggcgggaguucuccaaccuggagcgccggaucgagaaccucaacaagaagauggaggacggcuuccuggacguguggacguacaacgccgagcugcucguccugauggagaacgagcgcacccuggacuuccacgacagcaacgugaagaaccucuacgacaagguccggcugcagcugcgcgacaacgccaaggagcucgggaacggcugcuucgaguucuaccacaagugcgacaacgagugcauggaguccgugcggaacggcaccuacgacuacccccaguacagcgaggaggcccgccugaagcgggaggagaucuccggggugaagcuggagagcaucggcaccuaccagauccucuccaucuacagcacggucgccuccagccuggcgcuggccaucaugguggccgggcucucccuguggaugugcagcaacggcagccugcagugccgcaucugcaucuga

SEQ ID NO: 68732 - RNA, 1704 nt, Artificial Sequence
  derived and/or modified sequence opt1 from hemagglutinin__InfluenzaA__AEO89257
auggagaagaucgugcugcuccuggccaucgucagccuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccagcggcgucuccagcgcgugcccguaccagggcacccccuccuucuuccggaacgugguguggcugaucaagaagaacaacacguaccccaccaucaagcgcagcuacaacaacaccaaccaggaggaccuccugguccugugggggauccaccacuccaacgacgccgccgagcagaucaagcucuaccagaacccgaccacguacgugagcgugggcaccuccacccugaaccagcggcugguccccaagaucgccacccgcagcaaggugaacgggcaguccggccggauggacuucuucuggacgauccucaagagcaacgacgcgaucaacuucgagagcaacgggaacuucaucgcccccgaguacgccuacaagaucgugaagaagggcgacuccgccaucaugaaguccgaggucgaguacggcaacugcuccaccaagugccagacccccaucggggccaucaacagcuccaugccguuccacaacauccacccccugaccaucggcgagugccccaaguacgucaagagcaacaagcuggugcucgcgacggggcugcgcaacagcccccugcgggagcgccggcgcaagcggggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggugaacuccaucaucgacaagaugaacacccaguucgaggccgucgggcgcgaguucaacaaccuggagcggcgcaucgagaaccugaacaagaagauggaggacggcuuccucgacguguggacguacaacgccgagcugcugguccucauggagaacgagcggacccuggacuuccacgacagcaacgugaagaaccuguacgacaaggugcgccuccagcugcgggacaacgccaaggagcuggggaacggcugcuucgaguucuaccacaagugcgacaacgagugcauggaguccguccgcaacggcaccuacgacuacccgcaguacagcgaggaggcccggcucaagcgcgaggagaucuccggggugaagcuggagagcaucggcaccuaccagauccuguccaucuacagcacgguggcguccagccucguccuggccaucaugguggccgggcugagccucuggaugugcuccaacggcagccugcagugccgcaucugcaucuga

SEQ ID NO: 68733 - RNA, 1704 nt, Artificial Sequence; identical to SEQ ID NO: 68732
  derived and/or modified sequence opt1 from hemagglutinin__InfluenzaA__AEO89268

SEQ ID NO: 68734 - RNA, 1704 nt, Artificial Sequence
  derived and/or modified sequence opt1 from hemagglutinin__InfluenzaA__AEO89279
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugggggacugcuccgucgccggcuggcugcucgggaacccgaugugcgacaaguucaucaacgugcccgaguggagcuacaucguggagaaggccaaccccgccaacgaccugugcuaccccggcaacuucaacgacuacgaggagcugaagcaccuccugucccgcaucaaccacuucgagaagauccagaucauccccaagagcuccuggagcgaccacgaggccuccagcggcgucuccagcgcgugcccguaccaggggacccccuccuucuuccggaacgugguguggcugaucaagaagaacaacacguaccccaccaucaagcgcagcuacaacaacaccaaccaggaggaccuccugauccuguggggcauccaccacuccaacaacgccgccgagcaggagaagcucuaccagaacccgaccacguacaucagcgucgggaccuccacccugaaccagcggcuggugcccaagaucgccacccgcagcaaggugaacggccaguccgggcggauggacuucuucuggacgauccucaagcccaacgacgcgaucaacuucgagagcaacggcaacuucaucgcccccgaguacgccuacaagaucgucaagaagggcgacagcgccaucaugaaguccggggugaaguacggcaacugcaacaccaagugccagaccccgaucggggccaucaacagcuccaugcccuuccacaacauccacccccugaccaucggcgagugccccaaguacgucaagagcaacaagcuggugcucgcgacgggccugcgcaacuccccgcugcgggagcgccggcgcaagcggggccucuucggggccaucgccggguucaucgagggcggguggcagggcaugguggacggcugguacggguaccaccacagcaacgagcagggcuccggguacgccgccgacaaggagagcacccagaaggcgaucgacggcgugaccaacaaggucaacuccaucaucgacaagaugaacacccaguucgaggccguggggcgcgaguucaacaaccuggagcggcgcaucgagaaccugaacaagaagauggaggacggcuuccucgacguguggacguacaacgccgagcugcugguccucauggagaacgagcggacccuggacuuccacgacagcaacgugaagaaccuguacgacaagguccgccuccagcugcgggacaacgccaaggagcugggcaacgggugcuucgaguucuaccacaagugcgacaacgagugcauggaguccgugcgcaacggcaccuacgacuacccccaguacagcgaggaggcccggcucaagcgcgaggagaucuccggggugaagcuggagagcaucggcaccuaccagauccuguccaucuacagcacggcggccuccagccucgcccuggccaucauggucgccgggcugucccucuggaugugcagcaacggcagccugcagugccggaucugcaucuga

SEQ ID NO: 68735 - RNA, 1704 nt, Artificial Sequence
  derived and/or modified sequence opt1 from hemagglutinin__InfluenzaA__AEO89289
auggagaagaucgugcugcuccuggccaucgucagccuggccaaguccgaccagaucugcaucggcuaccacgcgaacaacagcaccgagcaggucgacaccaucauggagaagaacgugacggugacccacgcccaggacauccucgagaagacccacaacgggaagcugugcgaccuggacggcgugaagccccucauccugggggacugcuccguggccggcuggcugcucgggaacccgaugugcgacaaguucaucaacguccccgaguggagcuacaucguggagaaggugaaccccgccaacgaccugugcuaccccggcaacuucaacgacuacgaggagcugaagcaccuccugucccgcaucaaccacuucgagaagaucaagaucauccccaagagcuccuggagcgaccacgaggccuccagcggcgucuccagcgcgugcccguaccaggggacccccuccuucuuccggaacgugguguggcugaucaagaagaacaacacguaccccaccaucaagcgcagcuacaacaacaccaaccaggaggaccuccugauccuguggggcauccaccacuccaacaacgucgccgagcaggagaagcucuaccagaacccgaccacguacaucagcguggggaccuccacccugaaccagcggcuggugcccaagaucgccacccgcagcaaggucaacggccaguccgggcggauggacuucuucuggacgauccucaagcccaacgacaccaucaacuucgagagcaacggcaacuucaucgcccccgaguacgcguacaagaucgugaagaagggcgacagcgccaucaugaaguccgggguggaguacggcaacugcaacaccaagugccagaccccgaucggggccaucaacagcuccaugcccuuccacaacauccacccccugacgaucggcgagugccccaaguacgucaagagcaacaagcuggugcucgccaccggccugcgcaacuccccgcugcgggagcgccggcgcaagcggggccucuucggggccaucgcgggguucaucgagggcggguggcagggcaugguggacggcugguacggguaccaccacagcaacgagcagggcuccggguacgccgccgacaaggagagcacccagaaggccaucgacggcgucaccaacaaggugaacuccaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcugggcaacgggugcuucgaguucuaccacaagugcgacaacgagugcauggaguccgugcgcaacggcaccuacgacuacccccgguacagcgaggaggcccgccucaagcgggaggagaucuccggggucaagcuggagagcaucggcacguaccagauccuguccaucuacagcaccgccgccuccagccucgcgcuggccaucaugguggccgggcugucccucuggaugugcagcaacggcagccugcagugccgcaucugcaucuga

SEQ ID NO: 68736 - RNA, 1704 nt, Artificial Sequence
  derived and/or modified sequence opt1 from hemagglutinin__InfluenzaA__AEO89300
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagcacccgaccacguacaucagcgucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaaggagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucaacggggugaagcuggaguccaugggcaccuaccagauccugagcaucuacuccacggucgcgagcucccucgcccuggccaucaugguggccgggcugagcuucuggaugugcuccaacggcagccuccagugccgcaucugcaucuga

SEQ ID NO: 68737 - RNA, 1704 nt, Artificial Sequence
  derived and/or modified sequence opt1 from hemagglutinin__InfluenzaA__AEO89311
auggagaagaucgugcugcuguucgccaucgucagccuggugaaguccgaccacaucugcaucggcuaccacgccaacaacagcaccgagcaggucgacaccaucauggagaagaacgugacggugacccacgcgcaggacauccuggagaagacccacaacgggaagcucugcgaccugaacggcgugaagccccugauccucaaggacugcuccgucgccggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccucucccgcaucaaccacuucgagaagauccagaucaucccgaaggacagcugguccgaccacgaggccagccugggcgucuccgcggccugccccuaccagggcaacagcuccuucuuccggaacgugguguggcugaucaagaaggacaacgccuaccccaccaucaagaaguccuacaacaacacgaaccaggaggaccuccugauccugugggggauccaccaccccaacgacgaggccgagcagacccgccucuaccagaacccgaccaccuacaucagcaucggcacgagcacccugaaccagcggcugguccccaagaucgcgacccgcuccaaggugaacgggcagagcggccggaucgacuucuucuggaccauccucaagcccaacgacgccauccacuucgaguccaacgggaacuucaucgcccccgaguacgccuacaagaucgugaagaagggcgacagcacgaucaugaaguccgaggucgaguacggcaacugcaacacccgcugccagaccccgaugggggccaucaacagcagcaugcccuuccacaacauccacccccugaccaucggcgagugccccaaguacgugaaguccacgaagcuggugcucgcgaccgggcugcggaacagcccgcagcgcgagcggcgccggaagcgcggccuguucggcgccaucgccggguucaucgagggcggguggcagggcauggucgacgggugguacggcuaccaccacuccaacgagcagggcagcggguacgccgccgacaaggaguccacccagaaggcgaucgacggcgugaccaacaaggugaacagcaucaucgacaagaugaacacgcaguucgaggccgucgggcgggaguucaacaagcucgagcgccggaucgagaaccugaacaagaagauggaggacggcuuccuggacguguggaccuacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcaacaacgagugcauggagagcguccggaacggcaccuacgacuacccccaguacuccgaggaggcccgccugaagcgggaggagaucagcggggugaagcucgaguccaucggcaucuaccagauccugagcaucuacuccacgguggcgagcucccugguccucgccaucaugauggccgggcugagccuguggaugugcuccaacggcagccuccagugccgcaucugcaucuga

SEQ ID NO: 68738 - RNA, 1701 nt, Artificial Sequence; identical to SEQ ID NO: 62936
  derived and/or modified sequence opt1 from hemagglutinin__InfluenzaA__AEO99215

SEQ ID NO: 68739 - RNA, 1698 nt, Artificial Sequence
  derived and/or modified sequence opt1 from hemagglutinin__InfluenzaA__AEQ38187
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccgucgccagcagccuggugcuccuggugucccugggcgccaucagcuucuggaugugcuccaacgggagccuccagugccggaucugcaucuga

SEQ ID NO: 68740 - RNA, 1698 nt, Artificial Sequence; identical to SEQ ID NO: 68739
  derived and/or modified sequence opt1 from hemagglutinin__InfluenzaA__AEQ38188

SEQ ID NO: 68741 - RNA, 1698 nt, Artificial Sequence
  derived and/or modified sequence opt1 from hemagglutinin__InfluenzaA__AEQ38189
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccaaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 68742 - RNA, 1698 nt, Artificial Sequence
  derived and/or modified sequence opt1 from hemagglutinin__InfluenzaA__AEQ38190
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagcccuacgccaacaacaaggagaaggaggugcucguccuguggggcgugcaccacccgcccaacaucgccgugcagaagacccuguaccacacggagaacgccuacgucagcgugguguccagccacuacagccggaaguucacccccgagaucgccaagcgccccaagguccgggaccaggagggccgcaucaacuacuacuggacccuccuggagccgggcgacaccaucaucuucgaggcgaacgggaaccugaucgcgccccgguacgccuucgcccucucccgcggcuucgggagcggcaucaucaacuccaacgcccccauggacaagugcgacgccaagugccagacgccccagggcgccaucaacagcucccugccguuccagaacgugcaccccgugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgcgaaggagaucggcaacgggugcuucgaguucuaccacaagugcaacgacgagugcauggagagcgugaagaacggcaccuacgacuacccgaaguacuccgaggagagcaagcugaaccgcgagaagaucgacggggucaagcucgaguccaugggcguguaccagauccuggccaucuacagcaccguggccuccagccugguccuccuggugagccugggcgccaucuccuucuggaugugcagcaacgggucccuccagugccggaucugcaucuga

SEQ ID NO: 68743 - RNA, 1698 nt, Artificial Sequence; identical to SEQ ID NO: 64634
  derived and/or modified sequence opt1 from hemagglutinin__InfluenzaA__AEQ38191

SEQ ID NO: 68744 - RNA, 1698 nt, Artificial Sequence
  derived and/or modified sequence opt1 from hemagglutinin__InfluenzaA__AEQ38192
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucaccaagcgccccaaggugcgggaccaggagggccgcaucaacuacuacuggacccuccuggagcccggcgacacgaucaucuucgaggccaacgggaaccugaucgccccgcgguacgcguucgcccucucccgcggcuucgggagcggcaucaucaacuccaacacccccauggacaagugcgacaccaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgcgggguucaucgagggcggcuggaccgggaugguggacggcugguacggguaccaccaccagaacgagcagggcuccggguacgccgccgaccagaaguccacccagaacgccaucaacggcaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgcggagcugcuggugcuccuggagaacgagcggacgcuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgagagcaugggcgucuaccagauccuggccaucuacuccaccguggccagcucccuggugcuccuggucagccugggcgccaucuccuucuggaugugcagcaacgggucccuccagugccggaucugcaucuga

SEQ ID NO: 68745 - RNA, 1698 nt, Artificial Sequence
  derived and/or modified sequence opt1 from hemagglutinin__InfluenzaA__AEQ38193
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucguggaccagaagacccuguaccggacggagaacgccuacgugagcgucgugagcucccacuacagccgcaaguucacccccgagaucgccaagcggcccaaggugcgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 68746 - RNA, 1698 nt, Artificial Sequence
  derived and/or modified sequence opt1 from hemagglutinin__InfluenzaA__AEQ38194
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgccuacguguccgucgugagcucccacuacagccggaaguucacccccgagaucgccaagcgccccaaggugcgggaccaggagggccgcaucaacuacuacuggacccuccuggagcccggcgacaccaucaucuucgaggccuccgggaaccugaucgcgccgcgguacgccuucgcccucagccgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccggaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagcgccggauggagaaccucaacaagcgcgucgacgacggguucaucgacaucuggacguacaacgccgagcugcuggugcuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggagagcaagcugaaccgcgagaagaucgacggggugaagcucgaguccaugggcgucuaccagauccuggcgaucuacagcaccguggccuccagccuggugcuccuggucucccugggcgccaucagcuucuggaugugcuccaacgggagccuccagugccggaucugcaucuga

SEQ ID NO: 68747 - RNA, 1698 nt, Artificial Sequence
  derived and/or modified sequence opt1 from hemagglutinin__InfluenzaA__AEQ38195
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccaaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccaugggcaaggaguucaacaagcuggagcggcgcauggagaaccucaacaagaaggucgacgacggguucaucgacaucuggacguacaacgcggagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccguggccagcagccugguccuccuggugucccugggcgccaucagcuucuggaugugcuccaacgggagccuccagugccggaucugcaucuga

SEQ ID NO: 68748 - RNA, 1698 nt, Artificial Sequence
  derived and/or modified sequence opt1 from hemagglutinin__InfluenzaA__AEQ38196
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgaguaccccaaguacagcgaggaguccaagcugaaccgcgagaagaucgacggggugaagcucgagagcaugggcguguaccagauccuggccaucuacuccaccgucgccagcagccuggugcuccuggugucccugggcgccaucagcuucuggaugugcuccaacgggagccuccagugccggaucugcaucuga

SEQ ID NO: 68749 - RNA, 1698 nt, Artificial Sequence; identical to SEQ ID NO: 68739
  derived and/or modified sequence opt1 from hemagglutinin__InfluenzaA__AEQ38197

SEQ ID NO: 68750 - RNA, 1698 nt, Artificial Sequence; identical to SEQ ID NO: 68739
  derived and/or modified sequence opt1 from hemagglutinin__InfluenzaA__AEQ38198

SEQ ID NO: 68751 - RNA, 1701 nt, Artificial Sequence; identical to SEQ ID NO: 68058
  derived and/or modified sequence opt1 from hemagglutinin__InfluenzaA__AEQ62909

SEQ ID NO: 68752 - RNA, 1701 nt, Artificial Sequence
  derived and/or modified sequence opt1 from hemagglutinin__InfluenzaA__AEQ62910
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccgccucccccgacaacggcacgugcuaccccggcgacuucaucgacuacgaggagcugcgggagcagcucagcuccgugagcuccuucgagcgcuucgagaucuuccccaagaccagcuccuggccgaaccacgacagcaacaagggggucaccgccgccugcccccacgcgggcgccaaguccuucuacaagaaccugauguggcuggugaagaaggggaacagcuaccccaagcucuccaagagcuacaucaacgacaagggcaaggaggugcugguccugugggggauccaccacccgcccaccuccgccgaccagcagagccucuaccagaacgccgacgccuacguguucgugggcacgagccgguacuccaagaaguucaagcccgagaucgcgauccgccccaagguccggggccaggaggggcgcaugaacuacuacuggacccugguggagcccggcgacaagaucaccuucgaggccaccgggaaccugguggucccgcgguacgccuucgccauggagcgcaacgccggcagcggcaucaucaucuccgacacgcccgugcacgacugcaacacgaccugccagagccccaagggggcgaucaacaccucccuccccuuccagaacauccacccgaucaccaucggcgagugccccaaguacgucaagagcaccaagcugcggcuggccaccgggcuccgcaacgugcccuccgugcagagccggggccuguucggggccaucgccggcuucaucgagggcggguggaccggcaugguggacgggugguacggcuaccaccaccagaacgagcagggguccggcuacgccgcggaccucaagagcacgcagaacgccaucgacgagaucaccaacaaggucaacuccgugaucgagaagaugaacacccaguucaccgccgucggcaaggaguucaaccagcuggagaagcgcaucgagaaccugaacaagaagguggacgacggguuccuggacaucuggacguacaacgccgagcuccuggugcugcucgagaacgagcggacccuggacuaccacgacagcaacgucaagaaccuguacgagaaggugcgcucccagcucaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggucaagcuggagagcacccgcaucuaccagauccucgccaucuacuccaccguggccagcucccuggugcuggucgugagccucggcgccaucagcuucuggaugugcuccaacggcagccugcagugccggaucugcaucuga

SEQ ID NO: 68753 - RNA, 1701 nt, Artificial Sequence; identical to SEQ ID NO: 67875
  derived and/or modified sequence opt1 from hemagglutinin__InfluenzaA__AEQ62911

SEQ ID NO: 68754 - RNA, 1701 nt, Artificial Sequence; identical to SEQ ID NO: 68058
  derived and/or modified sequence opt1 from hemagglutinin__InfluenzaA__AEQ62912

SEQ ID NO: 68755 - RNA, 1701 nt, Artificial Sequence
  derived and/or modified sequence opt1 from hemagglutinin__InfluenzaA__AEQ62915
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagacgaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 68756 - RNA, 1701 nt, Artificial Sequence; identical to SEQ ID NO: 64419
  derived and/or modified sequence opt1 from hemagglutinin__InfluenzaA__AER08646

SEQ ID NO: 68757 - RNA, 1701 nt, Artificial Sequence; identical to SEQ ID NO: 66427
  derived and/or modified sequence opt1 from hemagglutinin__InfluenzaA__AER08648

SEQ ID NO: 68758 - RNA, 1701 nt, Artificial Sequence
  derived and/or modified sequence opt1 from hemagglutinin__InfluenzaA__AER08652
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccagcgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccugaaguccacccaggccgccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 68759 - RNA, 1701 nt, Artificial Sequence; identical to SEQ ID NO: 68758
  derived and/or modified sequence opt1 from hemagglutinin__InfluenzaA__AER08654

SEQ ID NO: 68760 - RNA, 1701 nt, Artificial Sequence
  derived and/or modified sequence opt1 from hemagglutinin__InfluenzaA__AER08656
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagaugcagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 68761 - RNA, 1701 nt, Artificial Sequence
  derived and/or modified sequence opt1 from hemagglutinin__InfluenzaA__AER08660
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 68762 - RNA, 1701 nt, Artificial Sequence
  derived and/or modified sequence opt1 from hemagglutinin__InfluenzaA__AER08664
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacagcgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgucaagcaguccacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 68763 - RNA, 1701 nt, Artificial Sequence; identical to SEQ ID NO: 67990
  derived and/or modified sequence opt1 from hemagglutinin__InfluenzaA__AER08668

SEQ ID NO: 68764 - RNA, 1701 nt, Artificial Sequence
  derived and/or modified sequence opt1 from hemagglutinin__InfluenzaA__AER08670
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugaaguccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 68765 - RNA, 1701 nt, Artificial Sequence
  derived and/or modified sequence opt1 from hemagglutinin__InfluenzaA__AER08672
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacgggggcaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacagcgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcagccagcaggccgugaucccgaacaucgggucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcaguccacccugaagcucgccaccggcaugcgcaacgugcccgagaagcagacccgggggaucuucggcgccaucgccggcuucaucgagaacgggugggagggcaugguggacgggugguacggcuuccgccaccagaacagcgaggggcggggccaggccgcggaccugaaguccacgcaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaaggggaacauccggugcaacaucugcaucuga

SEQ ID NO: 68766 - RNA, 1701 nt, Artificial Sequence
  derived and/or modified sequence opt1 from hemagglutinin__InfluenzaA__AER08674
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 68767 - RNA, 1701 nt, Artificial Sequence; identical to SEQ ID NO: 67990
  derived and/or modified sequence opt1 from hemagglutinin__InfluenzaA__AER08676

SEQ ID NO: 68768 - RNA, 1701 nt, Artificial Sequence; identical to SEQ ID NO: 67990
  derived and/or modified sequence opt1 from hemagglutinin__InfluenzaA__AER08678

SEQ ID NO: 68769 - RNA, 1701 nt, Artificial Sequence
  derived and/or modified sequence opt1 from hemagglutinin__InfluenzaA__AER08680
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcgcacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 68770 - RNA, 1701 nt, Artificial Sequence
  derived and/or modified sequence opt1 from hemagglutinin__InfluenzaA__AER08682
augaagaccgugaucgcccugagcuacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccagcgggcggaucaccguguccacgaagcgcagccagcaggccgucaucccgaacaucggcagccggccccgcgugcggaacauccccucccgcgugagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 68771 - RNA, 1701 nt, Artificial Sequence
  derived and/or modified sequence opt1 from hemagglutinin__InfluenzaA__AER08684
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcacgugcaucacccccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 68772 - RNA, 1701 nt, Artificial Sequence
  derived and/or modified sequence opt1 from hemagglutinin__InfluenzaA__AER08686
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcacgugcaucacccccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacaucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 68773 - RNA, 1701 nt, Artificial Sequence; identical to SEQ ID NO: 67990
  derived and/or modified sequence opt1 from hemagglutinin__InfluenzaA__AER08688

SEQ ID NO: 68774 - RNA, 1701 nt, Artificial Sequence
  derived and/or modified sequence opt1 from hemagglutinin__InfluenzaA__AER08690
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcaacagcccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcaggccgugaucccgaacaucgggagccggccccgcguccggaacauccccucccgcgugagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcacgugcaucacccccaacggcuccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacagcgagggccgggggcaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaagggcaacauccggugcaacaucugcaucuga

SEQ ID NO: 68775 - RNA, 1701 nt, Artificial Sequence; identical to SEQ ID NO: 67990
  derived and/or modified sequence opt1 from hemagglutinin__InfluenzaA__AER08692

SEQ ID NO: 68776 - RNA, 1701 nt, Artificial Sequence
  derived and/or modified sequence opt1 from hemagglutinin__InfluenzaA__AER08698
augaagaccaccaucgcccugagccacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccagcgggcgcaucaccguguccacgaagcggagccagcaggccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucacguacggggccugcccccgcuacgucaagcagagcacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacgcaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 68777 - RNA, 1701 nt, Artificial Sequence; identical to SEQ ID NO: 67990
  derived and/or modified sequence opt1 from hemagglutinin__InfluenzaA__AER08700

SEQ ID NO: 68778 - RNA, 1701 nt, Artificial Sequence
  derived and/or modified sequence opt1 from hemagglutinin__InfluenzaA__AER92712
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugaacaagagcuacaucaacgacaagggcaaggaggugcugguccucugggggauccaccaccccuccaccagcacggaccagcagagccuguaccagaacgccgacgccuacguguucgugggcaccucccgguacagcaagaaguucaagcccgagaucgccauccgcccgaagguccggaaccaggagggccgcaugaacuacuacuggacccugguggagcccggggacaagaucaccuucgaggccacgggcaaccucguggucccccgguacgcguucaccaucgagcgcaacgccggguccggcaucaucaucagcgacacccccauccacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcugguccuccuggagaacgagcggacgcuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggccagcucccugguccucguggugagccugggggcgaucagcuucuggaugugcuccaacggcagccugcagugccggaucugcaucuga

SEQ ID NO: 68779 - RNA, 1701 nt, Artificial Sequence; identical to SEQ ID NO: 66541
  derived and/or modified sequence opt1 from hemagglutinin__InfluenzaA__AET10090

SEQ ID NO: 68780 - RNA, 1701 nt, Artificial Sequence; identical to SEQ ID NO: 66541
  derived and/or modified sequence opt1 from hemagglutinin__InfluenzaA__AET10091

SEQ ID NO: 68781 - RNA, 1701 nt, Artificial Sequence; identical to SEQ ID NO: 66541
  derived and/or modified sequence opt1 from hemagglutinin__InfluenzaA__AET10092

SEQ ID NO: 68782 - RNA, 1701 nt, Artificial Sequence
  derived and/or modified sequence opt1 from hemagglutinin__InfluenzaA__AET10094
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccagcugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgucaagcaguccacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaccaucuaccacaagugcgacaacgccugcaucggguccauccgcaacggcaccuacgaccacaacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 68783 - RNA, 1701 nt, Artificial Sequence
  derived and/or modified sequence opt1 from hemagglutinin__InfluenzaA__AET10095
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacacccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucgaguccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 68784 - RNA, 1701 nt, Artificial Sequence
  derived and/or modified sequence opt1 from hemagglutinin__InfluenzaA__AET10096
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccugaucgacgcccuccugggggacccccagugcgacggcuuccagaacaagaaguggaaccuguucguggagcgcuccaaggccuacagcaacugcuaccccuacgacgugccggacuacgcgucccuccggagccuggucgccuccagcggcacgcuggaguucaacaacgaguccuucaacuggaccggggugacccagaacggcaccagcuccgccugcauccgccggagcaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccuccugaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 68785 - RNA, 1701 nt, Artificial Sequence
  derived and/or modified sequence opt1 from hemagglutinin__InfluenzaA__AET10098
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccugaucgacgcccuccugggggacccccagugcgacggcuuccagaacaagaagugggaccuguucguggagcgcuccaaggccuacagcaacugcuaccccuacgacgugccggacuacgcgucccuccggagccuggucgccuccagcggcacgcuggaguucaacaacgaguccuucaacuggaccggggugacccagaacggcaccagcuccgccugcauccgccggagcaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccuccugaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 68786 - RNA, 1701 nt, Artificial Sequence; identical to SEQ ID NO: 67863
  derived and/or modified sequence opt1 from hemagglutinin__InfluenzaA__AET10099

SEQ ID NO: 68787 - RNA, 1701 nt, Artificial Sequence; identical to SEQ ID NO: 67990
  derived and/or modified sequence opt1 from hemagglutinin__InfluenzaA__AET10100

SEQ ID NO: 68788 - RNA, 1701 nt, Artificial Sequence
  derived and/or modified sequence opt1 from hemagglutinin__InfluenzaA__AET10101
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccggggcggacaaggaccagaucuuccuguacgcccaggccagcgggcggaucaccguguccaccaagcgcagccagcaggccgugaucccgaacaucggcagccggccccgcguccggaacauccccucccgcaucagcaucuacuggacgaucgugaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucaccuacggggccugcccccgguacgucaagcagagcacgcugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaccaucuaccacaagugcgacaacgccugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 68789 - RNA, 1701 nt, Artificial Sequence
  derived and/or modified sequence opt1 from hemagglutinin__InfluenzaA__AET10102
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcaagaacugcacgcugaucgacgcccugcucggggacccccagugcgacggcuuccagaacaagaagugggaccuguucguggagcgcagcaaggccuacuccaacugcuaccccuucgacgugccggacuacgccagccugcggucccucgucgcgagcuccggcacccuggaguucaacaacgagagcuucaacuggaccggggugacccagaacggcacguccagcgccugcaugcgccgguccaagagcuccuucuucagccgccugaacuggcucacccaccugaacuucaaguaccccgcccugaacgugaccaugcccaacgacgagcaguucgacaagcucuacaucuggggcguccaccaccccgggaccgacaaggaccagaucuuccuguacgcccaggcguccgggcggaucacggugagcaccaagcgcagccagcagaccgugaucccgaacaucggcucccggccccgcauccggaacauccccagccgcaucuccaucuacuggaccaucgucaagcccggcgacauccugcucaucaacagcacggggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucaccuacggggccugcccccgguacgugaagcagaacacccugaagcucgccacgggcaugcgcaacguccccgagaagcagacccgggggaucuucggcgcgaucgccggguucaucgagaacggcugggagggcaugguggacgggugguacggcuuccgccaccagaacuccgaggggcggggccaggccgccgaccucaagagcacccaggccgcgaucgaccagaucaacgggaagcugaaccgccugaucggccggaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgccugcaucgggagcauccgcaacggcacguacgaccacgacguguaccgggacgaggcgcucaacaaccgcuuccagaucaagggggucgagcugaaguccggcuacaaggacuggauccuguggaucagcuucgccaucuccugcuuccuccugugcguggccagccugggcuucaucaugugggccugccagaaggggaacauccggugcaacaucugcaucuga

SEQ ID NO: 68790 - RNA, 1701 nt, Artificial Sequence
  derived and/or modified sequence opt1 from hemagglutinin__InfluenzaA__AET10103
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 68791 - RNA, 1701 nt, Artificial Sequence
  derived and/or modified sequence opt1 from hemagglutinin__InfluenzaA__AET10104
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccugaucgacgcccuccugggggacccccagugcgacggcuuccagaacaagaagugggaccuguucguggagcgcuccaaggccuacagcaacugcuaccccuacgacgugccggacuacgcgucccuccggagccuggucgccuccagcggcacgcuggaguucaacaacgaguccuucaacuggaccggggugacccagaacggcaccagcuccgccugcauccgccggagcaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccuccugaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggggaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcguggcccuccugggguucaucaugugggcgugccagaagggcaacauccggugcaacaucugcaucuga

SEQ ID NO: 68792 - RNA, 1701 nt, Artificial Sequence
  derived and/or modified sequence opt1 from hemagglutinin__InfluenzaA__AET10105
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 68793 - RNA, 1701 nt, Artificial Sequence
  derived and/or modified sequence opt1 from hemagglutinin__InfluenzaA__AET10106
augaagaccaucaucgcccugagcuacauccucugccugguguucgcccagaagcugcccggcaacuacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 68794 - RNA, 1701 nt, Artificial Sequence
  derived and/or modified sequence opt1 from hemagglutinin__InfluenzaA__AET10107
augaagaccaucaucgcccugagcuacauccucugccugguguucgcccaggagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccucaaguccacgcaggccgccaucgaccagaucaacgggaagcugaaccgccugaucggcaagaccaacgagaaguuccaccagaucgagaaggaguucagcgagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucuccuucgccaucagcugcuuccugcucugcgucgcgcugcugggcuucaucaugugggccugccagaaggggaacaucaagugcaacaucugcaucuga

SEQ ID NO: 68795 - RNA, 1701 nt, Artificial Sequence; identical to SEQ ID NO: 64419
  derived and/or modified sequence opt1 from hemagglutinin__InfluenzaA__AET10108

SEQ ID NO: 68796 - RNA, 1701 nt, Artificial Sequence; identical to SEQ ID NO: 67990
  derived and/or modified sequence opt1 from hemagglutinin__InfluenzaA__AET10109

SEQ ID NO: 68797 - RNA, 1701 nt, Artificial Sequence
  derived and/or modified sequence opt1 from hemagglutinin__InfluenzaA__AET10110
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacaucaagugcaacaucugcaucuga

SEQ ID NO: 68798 - RNA, 1701 nt, Artificial Sequence
  derived and/or modified sequence opt1 from hemagglutinin__InfluenzaA__AET10111
augaagaccaucaucgcccugagcuacauccucugccugguguucgcccaggagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcuguccaacagcaccgggaaccucaucggcccgcggggguacuucaagauccgcuccggcaagagcuccaucaugcggagcgacgcccccaucggcaagugcaacuccgccugcaucacccccaacgggagcauccccaacgacaagccguuccagaacgucaaccgcaucacguacggcgcgugcccccgguacgugaagcagaacacccugaagcuggccaccgggaugcgcaacgugcccgagaagcagacccggggcaucuucggggccaucgccggcuucaucgagaacggcugggaggggauggucgacggcugguacggguuccgccaccagaacuccgagggccgggggcaggccgcggaccucaagagcacgcaggccgccaucgaccagaucaacggcaagcugaaccgccugaucggcaagaccaacgagaaguuccaccagaucgagaaggaguucuccgagguggaggggcggauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcguggagcucaaguccggcuacaaggacuggauccuguggaucagcuucgccaucuccugcuuccugcucugcgucgcccugcugggguucaucaugugggcgugccagaagggcaacauccggugcaacaucugcaucuga

SEQ ID NO: 68799 - RNA, 1701 nt, Artificial Sequence
  derived and/or modified sequence opt1 from hemagglutinin__InfluenzaA__AET10113
augaagaccaucaucgcccugagcuacauccucugccugguguucgcccaggagcugcccggcaacgacaacuccaccgcgacgcucugccuggggcaccacgccguccagaacggcaccaucgugaagaccaucaccaacgaccagaucgaggugacgaacgccaccgagcugguccagagcuccagcaccggggagaucugcaacuccccgcaccagauccucgacggcgagaacugcacccugaucgacgcccugcucggggacccccagugcgacggcuuccagaacaagaagugggaccuguucguggagcgcagcaaggcccacuccaacugcuaccccuacgacgugcccgacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguacccggcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugauccccaacaucggcagccggccgcgcguccggaacauccccucccgcgugagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgccugcaucacccccaacggcuccauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcucaagagcggcuacaaggacuggauccuguggaucuccuucgccaucagcugcuuccugcugugcgucgcgcugcucggcuucaucaugugggccugccagaaggggaacauccggugcaacaucugcaucuga

SEQ ID NO: 68800 - RNA, 1701 nt, Artificial Sequence
  derived and/or modified sequence opt1 from hemagglutinin__InfluenzaA__AET10114
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccaucagcaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacaucaugugcaacaucugcaucuga

SEQ ID NO: 68801 - RNA, 1698 nt, Artificial Sequence
  derived and/or modified sequence opt1 from hemagglutinin__InfluenzaA__AET50439
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 68802 - RNA, 1698 nt, Artificial Sequence
  derived and/or modified sequence opt1 from hemagglutinin__InfluenzaA__AET50440
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccacgcacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 68803 - RNA, 1698 nt, Artificial Sequence
  derived and/or modified sequence opt1 from hemagglutinin__InfluenzaA__AET50441
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccacgcacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacacggagaacgccuacgugagcgucgugagcucccacuacagccggaaguucacccccgagaucgccaagcgccccaaggugcggggccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 68804 - RNA, 1698 nt, Artificial Sequence
  derived and/or modified sequence opt1 from hemagglutinin__InfluenzaA__AET50442
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacggcaucugcuaccccggccacuucgccgacuacgaggagcugcgcgagcagcucuccagcguguccagcuucgagcgguucgagaucuucccgaaggaguccagcuggcccacccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagaaggcccuguaccacaccgagaacgccuacgugagcgucgugagcucccacuacagccggaaguucacgcccgagaucgccaagcgccccaaggugcggggccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 68805 - RNA, 1698 nt, Artificial Sequence
  derived and/or modified sequence opt1 from hemagglutinin__InfluenzaA__AET84163
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagagccucaucuccaaggagagcugguccuacaucguggagaagcccaaccccgagaacgggaccugcuaccccggccacuucgccgacuacgaggagcugcgcgagcagcugagcuccgugagcuccuucgagcgguucgagaucuucccgaaggagagcuccuggcccaaccacacggucaccggggugagcgccuccugcagccacaacggcgaguccagcuucuaccgcaaccuccuguggcugaccgggaagaacggccucuaccccaaccuguccaagagcuacgccaacaacaaggagaaggaggugcugguccucuggggcgugcaccacccgcccagcaucuccaaccagaagacccuguaccacacggagaacgccuacgugagcgucguguccagccacuacucccggaaguucacccccgagguggccaagcgccccaagguccgggaccaggagggccgcaucaacuacuacuggacccugcucgagcccggcgacaccaucaucuucgaggccaacgggaaccugaucgcgccgcgguacgccuucgcccugagccgcggcuucggguccggcaucaucaacagcaacgcccccauggacaagugcgacgccaagugccagacgccccagggcgcgaucaacuccagccuccccuuccagaacgugcacccggugaccaucggggagugccccaaguacguccgguccgccaagcugcgcauggugaccggccugcggaacauccccagcauccagucccgcggccucuucggggccaucgccggguucaucgagggcggcuggaccgggaugguggacggcugguacggguaccaccaccagaacgagcagggcagcggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccugaacaagaagguggacgacggguucaucgacaucuggacguacaacgccgagcuccuggugcugcucgagaacgagcggacccuggacuuccacgacuccaacgucaagaaccuguacgagaaggucaagagccagcucaagaacaacgccaaggagaucggcaacgggugcuucgaguucuaccacaagugcaacgacgagugcauggaguccgugaagaacggcaccuacgacuaccccaaguacagcgaggagagcaagcugaaccgcgagaagaucgacggggugaagcuggaguccaugggcguguaccagauccucgcgaucuacagcaccguggccuccagccugguccugcucgugucccugggcgccaucagcuucuggaugugcuccaacgggagccugcagugccggaucugcaucuga

SEQ ID NO: 68806 - RNA, 1698 nt, Artificial Sequence
  derived and/or modified sequence opt1 from hemagglutinin__InfluenzaA__AET84174
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucauccggggcuucggguccggcaucaucaacagcaacgcccccaugggcaagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggcgaucuacuccaccguggccagcagccugguccuccuggugucccugggggccaucagcuucuggaugugcuccaacggcagccuccagugccgcaucugcaucuga

SEQ ID NO: 68807 - RNA, 1698 nt, Artificial Sequence
  derived and/or modified sequence opt1 from hemagglutinin__InfluenzaA__AET84196
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagagccucaucuccaaggagagcugguccuacaucguggagaagcccaaccccgagaacgggaccugcuaccccggccacuucgccgacuacgaggagcugcgcgagcagcugagcuccgugagcuccuucgagcgguucgagaucuucccgaaggagagcuccuggcccaaccacacggucaccggggugagcgccuccugcagccacaacggcgaguccagcuucuaccgcaaccuccuguggcugacccggaagaacgggcucuaccccacccuguccaagagcuacgccaacaacaaggagaaggaggugcugguccucuggggcgugcaccacccgcccagcaucaacgaccagaagacgcuguaccacaccgagaacgccuacguguccgucgugagcucccacuacagccgcaaguucacccccgagaucgccaagcggcccaaggugcgcgaccaggaggggcggaucaacuacuacuggacccugcucgagcccggcgacacgaucaucuucgaggccaacggcaaccugaucgcgccgcgcuacgccuucgcccugucccggggguucggcagcgggaucaucaacuccagcgcccccauggacaagugcgacgccaagugccagacgccccagggcgcgaucaacuccagccuccccuuccagaacguccacccggugaccaucggcgagugccccaaguacgugcgcuccgccaagcugcggauggucaccgggcugcgcaacauccccagcauccagucccggggccucuucggggccaucgccggcuucaucgagggcggcuggaccggcaugguggacgggugguacggcuaccaccaccagaacgagcaggggagcggcuacgccgcggaccagaaguccacccagaacgccaucaacgggaucaccaacaaggugaacagcgucaucgagaagaugaacacccaguucacggccgugggcaaggaguucaacaagcuggagcgccggauggagaaccugaacaagaaggucgacgacggcuucaucgacaucuggaccuacaacgccgagcuccuggugcugcucgagaacgagcgcacccuggacuuccacaacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggggucuaccagauccucgcgaucuacagcacgguggccuccagccuggugcugcucgucucccugggcgccaucagcuucuggaugugcuccaacggcagccugcagugccgcaucugcaucuga

SEQ ID NO: 68808 - RNA, 1698 nt, Artificial Sequence
  derived and/or modified sequence opt1 from hemagglutinin__InfluenzaA__AET84207
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcgugccguccuucgagcgguucgagaucuuccccaaggagagcuccuggcccaaccacacggucaccggggugagcgccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagccgcgggacaccaucaucuucgaggccaacggcaaccugaucgcgccccgcuacgccuucgcccucucccggggguucggcagcgggaucaucaacuccaacgcccccauggacaagugcgacgccaagugccagacgccccagggcgcgaucaacagcucccugccguuccagaacguccaccccgugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggcuucaucgacaucuggacguacaacgccgagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuacccgaaguacuccgaggagagcaagcugaaccgggagaagaucgacggcgugaagcucgaguccaugggggucuaccagauccuggcgaucuacagcaccguggccagcucccuggugcuccuggucagccugggcgccaucuccuucuggaugugcagcaacggcucccuccagugccgcaucugcaucuga

SEQ ID NO: 68809 - RNA, 1698 nt, Artificial Sequence
  derived and/or modified sequence opt1 from hemagglutinin__InfluenzaA__AET84218
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucagcaaccagaagacccuguaccacacggagaacgccuacgugagcgucguguccagccacuacucccggaaguucacccccgagaucgccaagcgccccaaggugcgggaccaggagggccgcaucaacuacuacuggacccuccuggagcccggcgacaccaucaucuucgaggccagcgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgagagcaugggcgucuaccagauccuggcgaucuacuccaccguggccagcucccuggugcuccuggucagccugggcgccaucuccuucuggaugugcagcaacgggucccuccagugccggaucugcaucuga

SEQ ID NO: 68810 - RNA, 1698 nt, Artificial Sequence
  derived and/or modified sequence opt1 from hemagglutinin__InfluenzaA__AET84229
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccacccugagcaaguccuacgccaacaacaaggagaaggaggugcucguccuguggggcgugcaccacccgcccaacaucguggaccagaagacgcuguaccggaccgagaacgccuacgucagcguggugagcucccacuacagccgcaaguucacccccgagaucgccaagcggcccaagguccgcgaccaggagggccggaucaacuacuacuggacccuccuggagcccggcgacacgaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacaucccgcccauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacccaguucacggccgucgggaaggaguucaacaagcuggagcgccggauggagaaccucaacaagaagguggacgacggcuucaucgacaucuggaccuacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggcgaucuacuccacgguggccagcagccugguccuccuggugucccugggggccaucagcuucuggaugugcuccaacggcagccuccagugccgcaucugcaucuga

SEQ ID NO: 68811 - RNA, 1698 nt, Artificial Sequence
  derived and/or modified sequence opt1 from hemagglutinin__InfluenzaA__AET84240
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 68812 - RNA, 1698 nt, Artificial Sequence
  derived and/or modified sequence opt1 from hemagglutinin__InfluenzaA__AET84251
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucgugaaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccacggggcgaucaacagcugccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacuccaacgucaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaacaaggagaagaucgacggcgugaagcucgagagcaugggcguguaccagauccuggcgaucuacuccaccguggccagcagccugguccuccuggugucccugggggccaucagcuucuggaugugcuccaacggcagccuccagugccggaucugcaucuga

SEQ ID NO: 68813 - RNA, 1698 nt, Artificial Sequence
  derived and/or modified sequence opt1 from hemagglutinin__InfluenzaA__AET84262
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccacggcgcgaucaacagcugccugcccuuccagaacgugcacccggugaccaucggggagugccccaaguacguccgcuccgccaagcugcggauggugaccggccuccgcaacauccccagcauccagucccgggggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcucgagagcaugggcguguaccagauccuggcgaucuacuccaccguggccagcagccugguccuccuggugucccugggcgccaucagcuucuggaugugcuccaacgggagccuccagugccgcaucugcaucuga

SEQ ID NO: 68814 - RNA, 1698 nt, Artificial Sequence; identical to SEQ ID NO: 68741
  derived and/or modified sequence opt1 from hemagglutinin__InfluenzaA__AET84284

SEQ ID NO: 68815 - RNA, 1698 nt, Artificial Sequence
  derived and/or modified sequence opt1 from hemagglutinin__InfluenzaA__AET84306
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacaccgagaacgccuacgugagcgucgugagcucccacuacagcaucaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 68816 - RNA, 1698 nt, Artificial Sequence
  derived and/or modified sequence opt1 from hemagglutinin__InfluenzaA__AET84339
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccaaccuguccaagagcuacgccaacaacaaggagaaggaggugcucguccuguggggcgugcaccacccgcccaacaucggcaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccagcagccuggugcuccuggucucccugggggccaucagcuucuggaugugcuccaacggcagccuccagugccgcaucugcaucuga

SEQ ID NO: 68817 - RNA, 1698 nt, Artificial Sequence; identical to SEQ ID NO: 68816
  derived and/or modified sequence opt1 from hemagglutinin__InfluenzaA__AET84361

SEQ ID NO: 68818 - RNA, 1698 nt, Artificial Sequence
  derived and/or modified sequence opt1 from hemagglutinin__InfluenzaA__AET84372
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccaaccuguccaagagcuacgccaacaacaaggagaaggaggugcucguccuguggggcgugcaccacccgcccaacaucggcgaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccaccguggccagcagccuggugcuccuggucucccugggggccaucagcuucuggaugugcuccaacggcagccuccagugccgcaucugcaucuga

SEQ ID NO: 68819 - RNA, 1698 nt, Artificial Sequence
  derived and/or modified sequence opt1 from hemagglutinin__InfluenzaA__AET84394
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccaaccuguccaagagcuacgccaacaacaaggagaaggaggugcucguccuguggggcgugcaccacccgcccgacaucggcaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgagaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgccgaccagaaguccacgcagaacgcgaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggcgagcagccuggugcuccuggucucccugggggccaucagcuucuggaugugcuccaacggcagccuccagugccgcaucugcaucuga

SEQ ID NO: 68820 - RNA, 1698 nt, Artificial Sequence; identical to SEQ ID NO: 66524
  derived and/or modified sequence opt1 from hemagglutinin__InfluenzaA__AET84405

SEQ ID NO: 68821 - RNA, 1698 nt, Artificial Sequence
  derived and/or modified sequence opt1 from hemagglutinin__InfluenzaA__AET84416
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccacccuguccaagagcuacgccaacaacaaggagaaggaggugcucguccuguggggcgugcaccacccgcccgacaucggcgaccagaagacgcuguaccacaccgagaacgccuacguguccgucgugagcagccacuacucccgcaaguucacccccgagaucgccaagcggcccaaggugcgcgaccaggagggccggaucaacuacuacuggacccuccuggagcccggggacacgaucaucuucgaggccaacggcaaccugaucgcgccgcgcuacgccuucgcccucagccggggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggcgaucuacuccacgguggccagcagccuggugcuccuggucucccugggggccaucagcuucuggaugugcuccaacggcagccuccagugccgcaucugcaucuga

SEQ ID NO: 68822 - RNA, 1698 nt, Artificial Sequence
  derived and/or modified sequence opt1 from hemagglutinin__InfluenzaA__AET84427
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 68823 - RNA, 1698 nt, Artificial Sequence
  derived and/or modified sequence opt1 from hemagglutinin__InfluenzaA__AET84438
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaagacccuguacaacacggagaacgccuacgucagcguggugagcucccacuacagccggaaguucacccccgagaucgccaagcgccccaagguccgggaccaggagggccgcaucaacuacuacuggacccuccuggagcccggggacaccaucauguucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 68824 - RNA, 1698 nt, Artificial Sequence
  derived and/or modified sequence opt1 from hemagglutinin__InfluenzaA__AET84449
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgggugcgacgcgaagugccagacgccccagggcgccaucaacagcucccugcccuuccagaacgugcacccggucaccaucggggagugccccaaguacgugcgcagcgccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacagcaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacagcaccgucgccagcucccuggugcuccuggugagccugggcgccaucuccuucuggaugugcagcaacgggucccuccagugccgcaucugcaucuga

SEQ ID NO: 68825 - RNA, 1701 nt, Artificial Sequence
  derived and/or modified sequence opt1 from hemagglutinin__InfluenzaA__AET98600
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccguccccaacaacgagcaguucgacaagcucuacaucuggggcgugcaccaccccgggaccgacaaggaccagaucuuccuguacgcgcaggccagcgggcggaucaccguguccacgaagcgcagccagcaggccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgucaaccgcaucacguacggggcgugcccccgguacgugaagcagagcacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggagcauccgcaacggcaccuacgaccacaacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggcgugccagaaggggaacauccggugcaacaucugcaucuga

SEQ ID NO: 68826 - RNA, 1701 nt, Artificial Sequence
  derived and/or modified sequence opt1 from hemagglutinin__InfluenzaA__AEV76874
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaaccccgagaucgagauccgcccgaagguccgggaccaggaggggcgcaugaacuacuacuggacccugguggagcccggcgacaagaucacguucgaggccaccgggaaccugguggucccccgguacgccuucgcgauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggguuccuggacaucuggaccuacaacgcggagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgccuccagccuggugcugguggucucccucggcgcgaucagcuucuggaugugcagcaacggcucccugcagugccggaucugcaucuga

SEQ ID NO: 68827 - RNA, 1701 nt, Artificial Sequence; identical to SEQ ID NO: 63677
  derived and/or modified sequence opt1 from hemagglutinin__InfluenzaA__AEW10574

SEQ ID NO: 68828 - RNA, 1701 nt, Artificial Sequence; identical to SEQ ID NO: 63677
  derived and/or modified sequence opt1 from hemagglutinin__InfluenzaA__AEW10584

SEQ ID NO: 68829 - RNA, 1701 nt, Artificial Sequence; identical to SEQ ID NO: 64030
  derived and/or modified sequence opt1 from hemagglutinin__InfluenzaA__AEW10594

SEQ ID NO: 68830 - RNA, 1701 nt, Artificial Sequence; identical to SEQ ID NO: 64030
  derived and/or modified sequence opt1 from hemagglutinin__InfluenzaA__AEW10604

SEQ ID NO: 68831 - RNA, 1701 nt, Artificial Sequence; identical to SEQ ID NO: 64030
  derived and/or modified sequence opt1 from hemagglutinin__InfluenzaA__AEW10614

SEQ ID NO: 68832 - RNA, 1701 nt, Artificial Sequence; identical to SEQ ID NO: 64030
  derived and/or modified sequence opt1 from hemagglutinin__InfluenzaA__AEW10624

SEQ ID NO: 68833 - RNA, 1701 nt, Artificial Sequence; identical to SEQ ID NO: 63677
  derived and/or modified sequence opt1 from hemagglutinin__InfluenzaA__AEW10634

SEQ ID NO: 68834 - RNA, 1701 nt, Artificial Sequence; identical to SEQ ID NO: 63664
  derived and/or modified sequence opt1 from hemagglutinin__InfluenzaA__AEW10644

SEQ ID NO: 68835 - RNA, 1701 nt, Artificial Sequence
  derived and/or modified sequence opt1 from hemagglutinin__InfluenzaA__AEW10654
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68836 - RNA, 1701 nt, Artificial Sequence; identical to SEQ ID NO: 63664
  derived and/or modified sequence opt1 from hemagglutinin__InfluenzaA__AEW10664

SEQ ID NO: 68837 - RNA, 1701 nt, Artificial Sequence
  derived and/or modified sequence opt1 from hemagglutinin__InfluenzaA__AEW10674
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccgaggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 68838 - RNA, 1701 nt, Artificial Sequence; identical to SEQ ID NO: 63677
  derived and/or modified sequence opt1 from hemagglutinin__InfluenzaA__AEW10684

SEQ ID NO: 68839 - RNA, 1701 nt, Artificial Sequence; identical to SEQ ID NO: 63664
  derived and/or modified sequence opt1 from hemagglutinin__InfluenzaA__AEW10694

SEQ ID NO: 68840 - RNA, 1701 nt, Artificial Sequence; identical to SEQ ID NO: 63664
  derived and/or modified sequence opt1 from hemagglutinin__InfluenzaA__AEW10704

SEQ ID NO: 68841 - RNA, 1701 nt, Artificial Sequence; identical to SEQ ID NO: 68835
  derived and/or modified sequence opt1 from hemagglutinin__InfluenzaA__AEW10724

SEQ ID NO: 68842 - RNA, 1701 nt, Artificial Sequence; identical to SEQ ID NO: 63677
  derived and/or modified sequence opt1 from hemagglutinin__InfluenzaA__AEW10734

SEQ ID NO: 68843 - RNA, 1701 nt, Artificial Sequence
  derived and/or modified sequence opt1 from hemagglutinin__InfluenzaA__AEW10744
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccugucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68844 - RNA, 1701 nt, Artificial Sequence; identical to SEQ ID NO: 68843
  derived and/or modified sequence opt1 from hemagglutinin__InfluenzaA__AEW10754

SEQ ID NO: 68845 - RNA, 1701 nt, Artificial Sequence
  derived and/or modified sequence opt1 from hemagglutinin__InfluenzaA__AEW10764
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccaacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 68846 - RNA, 1701 nt, Artificial Sequence; identical to SEQ ID NO: 63921
  derived and/or modified sequence opt1 from hemagglutinin__InfluenzaA__AEW10774

SEQ ID NO: 68847 - RNA, 1701 nt, Artificial Sequence; identical to SEQ ID NO: 63664
  derived and/or modified sequence opt1 from hemagglutinin__InfluenzaA__AEW10784

SEQ ID NO: 68848 - RNA, 1701 nt, Artificial Sequence; identical to SEQ ID NO: 63664
  derived and/or modified sequence opt1 from hemagglutinin__InfluenzaA__AEW10794

SEQ ID NO: 68849 - RNA, 1701 nt, Artificial Sequence; identical to SEQ ID NO: 63857
  derived and/or modified sequence opt1 from hemagglutinin__InfluenzaA__AEW10804

SEQ ID NO: 68850 - RNA, 1701 nt, Artificial Sequence; identical to SEQ ID NO: 63675
  derived and/or modified sequence opt1 from hemagglutinin__InfluenzaA__AEW10814

SEQ ID NO: 68851 - RNA, 1701 nt, Artificial Sequence; identical to SEQ ID NO: 63768
  derived and/or modified sequence opt1 from hemagglutinin__InfluenzaA__AEW10824

SEQ ID NO: 68852 - RNA, 1701 nt, Artificial Sequence; identical to SEQ ID NO: 63664
  derived and/or modified sequence opt1 from hemagglutinin__InfluenzaA__AEW10834

SEQ ID NO: 68853 - RNA, 1701 nt, Artificial Sequence; identical to SEQ ID NO: 63857
  derived and/or modified sequence opt1 from hemagglutinin__InfluenzaA__AEW10844

SEQ ID NO: 68854 - RNA, 1701 nt, Artificial Sequence
  derived and/or modified sequence opt1 from hemagglutinin__InfluenzaA__AEW10854
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucacgauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcagugccggaucugcaucuga

SEQ ID NO: 68855 - RNA, 1701 nt, Artificial Sequence; identical to SEQ ID NO: 63857
  derived and/or modified sequence opt1 from hemagglutinin__InfluenzaA__AEW10864

SEQ ID NO: 68856 - RNA, 1701 nt, Artificial Sequence; identical to SEQ ID NO: 63857
  derived and/or modified sequence opt1 from hemagglutinin__InfluenzaA__AEW10874

SEQ ID NO: 68857 - RNA, 1701 nt, Artificial Sequence; identical to SEQ ID NO: 63857
  derived and/or modified sequence opt1 from hemagglutinin__InfluenzaA__AEW10884

SEQ ID NO: 68858 - RNA, 1701 nt, Artificial Sequence; identical to SEQ ID NO: 63664
  derived and/or modified sequence opt1 from hemagglutinin__InfluenzaA__AEW10894

SEQ ID NO: 68859 - RNA, 1701 nt, Artificial Sequence; identical to SEQ ID NO: 63857
  derived and/or modified sequence opt1 from hemagglutinin__InfluenzaA__AEW10904

SEQ ID NO: 68860 - RNA, 1701 nt, Artificial Sequence; identical to SEQ ID NO: 63857
  derived and/or modified sequence opt1 from hemagglutinin__InfluenzaA__AEW10914

SEQ ID NO: 68861 - RNA, 1701 nt, Artificial Sequence; identical to SEQ ID NO: 63664
  derived and/or modified sequence opt1 from hemagglutinin__InfluenzaA__AEW10924

SEQ ID NO: 68862 - RNA, 1701 nt, Artificial Sequence; identical to SEQ ID NO: 63664
  derived and/or modified sequence opt1 from hemagglutinin__InfluenzaA__AEW10934

SEQ ID NO: 68863 - RNA, 1701 nt, Artificial Sequence; identical to SEQ ID NO: 63857
  derived and/or modified sequence opt1 from hemagglutinin__InfluenzaA__AEW10944

SEQ ID NO: 68864 - RNA, 1701 nt, Artificial Sequence; identical to SEQ ID NO: 63677
  derived and/or modified sequence opt1 from hemagglutinin__InfluenzaA__AEW10954

SEQ ID NO: 68865 - RNA, 1701 nt, Artificial Sequence; identical to SEQ ID NO: 63677
  derived and/or modified sequence opt1 from hemagglutinin__InfluenzaA__AEW10964

SEQ ID NO: 68866 - RNA, 1701 nt, Artificial Sequence; identical to SEQ ID NO: 63857
  derived and/or modified sequence opt1 from hemagglutinin__InfluenzaA__AEW10974

SEQ ID NO: 68867 - RNA, 1701 nt, Artificial Sequence; identical to SEQ ID NO: 63677
  derived and/or modified sequence opt1 from hemagglutinin__InfluenzaA__AEW10984

SEQ ID NO: 68868 - RNA, 1701 nt, Artificial Sequence; identical to SEQ ID NO: 63677
  derived and/or modified sequence opt1 from hemagglutinin__InfluenzaA__AEW10994

SEQ ID NO: 68869 - RNA, 1701 nt, Artificial Sequence; identical to SEQ ID NO: 63677
  derived and/or modified sequence opt1 from hemagglutinin__InfluenzaA__AEW11004

SEQ ID NO: 68870 - RNA, 1701 nt, Artificial Sequence; identical to SEQ ID NO: 63677
  derived and/or modified sequence opt1 from hemagglutinin__InfluenzaA__AEW11014

SEQ ID NO: 68871 - RNA, 1701 nt, Artificial Sequence; identical to SEQ ID NO: 63677
  derived and/or modified sequence opt1 from hemagglutinin__InfluenzaA__AEW11024

SEQ ID NO: 68872 - RNA, 1701 nt, Artificial Sequence; identical to SEQ ID NO: 63677
  derived and/or modified sequence opt1 from hemagglutinin__InfluenzaA__AEW11034

SEQ ID NO: 68873 - RNA, 1701 nt, Artificial Sequence; identical to SEQ ID NO: 63857
  derived and/or modified sequence opt1 from hemagglutinin__InfluenzaA__AEW11044

SEQ ID NO: 68874 - RNA, 1701 nt, Artificial Sequence; identical to SEQ ID NO: 63677
  derived and/or modified sequence opt1 from hemagglutinin__InfluenzaA__AEW11054

SEQ ID NO: 68875 - RNA, 1701 nt, Artificial Sequence; identical to SEQ ID NO: 63664
  derived and/or modified sequence opt1 from hemagglutinin__InfluenzaA__AEW11064

SEQ ID NO: 68876 - RNA, 1701 nt, Artificial Sequence; identical to SEQ ID NO: 63664
  derived and/or modified sequence opt1 from hemagglutinin__InfluenzaA__AEW11074

SEQ ID NO: 68877 - RNA, 1701 nt, Artificial Sequence
  derived and/or modified sequence opt1 from hemagglutinin__InfluenzaA__AEW11084
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcaccuccgccgaccagcagagccuguaccagaacgccgacgccuacguguucgugggcuccagccgguacuccaagaaguucaagcccgagaucgccauccgccccaagguccgggaccaggagggccgcaugaacuacuacuggacgcucguggagccgggggacaagaucaccuucgaggcgaccggcaaccugguggucccccgguacgccuucgccauggagcgcaacgccgggagcggcaucaucaucuccgacacccccgugcacgacugcaacacgaccugccagacccccaagggcgccaucaacaccagccugccguuccagaacauccaccccaucacgaucgggaagugccccaaguacgugaaguccaccaagcuccggcuggcgaccggccugcgcaacguccccagcauccagucccggggccucuucggggccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgggaggagaucgacggcgugaagcuggaguccacccgcaucuaccagauccuggcgaucuacagcaccgucgccagcucccucgugcugguggucagccugggggccaucuccuucuggaugugcagcaacggcucccuccagugccggaucugcaucuga

SEQ ID NO: 68878 - RNA, 1701 nt, Artificial Sequence; identical to SEQ ID NO: 63664
  derived and/or modified sequence opt1 from hemagglutinin__InfluenzaA__AEW11094

SEQ ID NO: 68879 - RNA, 1701 nt, Artificial Sequence; identical to SEQ ID NO: 63664
  derived and/or modified sequence opt1 from hemagglutinin__InfluenzaA__AEW11104

SEQ ID NO: 68880 - RNA, 1701 nt, Artificial Sequence; identical to SEQ ID NO: 63677
  derived and/or modified sequence opt1 from hemagglutinin__InfluenzaA__AEW11114

SEQ ID NO: 68881 - RNA, 1701 nt, Artificial Sequence
  derived and/or modified sequence opt1 from hemagglutinin__InfluenzaA__AEW11124
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguucgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 68882 - RNA, 1701 nt, Artificial Sequence
  derived and/or modified sequence opt1 from hemagglutinin__InfluenzaA__AEW11134
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaacaaggaggagaucgacggcgugaagcuggaguccacccggaucuaccagauccucgcgaucuacagcaccgucgccagcucccuggugcugguggucagccucggggccaucuccuucuggaugugcagcaacggcucccugcagugccgcaucugcaucuga

SEQ ID NO: 68883 - RNA, 1701 nt, Artificial Sequence; identical to SEQ ID NO: 63677
  derived and/or modified sequence opt1 from hemagglutinin__InfluenzaA__AEW11144

SEQ ID NO: 68884 - RNA, 1701 nt, Artificial Sequence; identical to SEQ ID NO: 63677
  derived and/or modified sequence opt1 from hemagglutinin__InfluenzaA__AEW11154

SEQ ID NO: 68885 - RNA, 1701 nt, Artificial Sequence; identical to SEQ ID NO: 68877
  derived and/or modified sequence opt1 from hemagglutinin__InfluenzaA__AEW11164

SEQ ID NO: 68886 - RNA, 1701 nt, Artificial Sequence; identical to SEQ ID NO: 68877
  derived and/or modified sequence opt1 from hemagglutinin__InfluenzaA__AEW11174

SEQ ID NO: 68887 - RNA, 1701 nt, Artificial Sequence; identical to SEQ ID NO: 63677
  derived and/or modified sequence opt1 from hemagglutinin__InfluenzaA__AEW11184

SEQ ID NO: 68888 - RNA, 1701 nt, Artificial Sequence; identical to SEQ ID NO: 63664
  derived and/or modified sequence opt1 from hemagglutinin__InfluenzaA__AEW11194

SEQ ID NO: 68889 - RNA, 1701 nt, Artificial Sequence; identical to SEQ ID NO: 63677
  derived and/or modified sequence opt1 from hemagglutinin__InfluenzaA__AEW11204

SEQ ID NO: 68890 - RNA, 1701 nt, Artificial Sequence; identical to SEQ ID NO: 63677
  derived and/or modified sequence opt1 from hemagglutinin__InfluenzaA__AEW11214

SEQ ID NO: 68891 - RNA, 1701 nt, Artificial Sequence; identical to SEQ ID NO: 63857
  derived and/or modified sequence opt1 from hemagglutinin__InfluenzaA__AEW11224

SEQ ID NO: 68892 - RNA, 1701 nt, Artificial Sequence; identical to SEQ ID NO: 63677
  derived and/or modified sequence opt1 from hemagglutinin__InfluenzaA__AEW11234

SEQ ID NO: 68893 - RNA, 1701 nt, Artificial Sequence; identical to SEQ ID NO: 63677
  derived and/or modified sequence opt1 from hemagglutinin__InfluenzaA__AEW11244

SEQ ID NO: 68894 - RNA, 1701 nt, Artificial Sequence
  derived and/or modified sequence opt1 from hemagglutinin__InfluenzaA__AEW11254
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugccugcacgccggcgcgaaguccuucuacaagaaccucaucuggcuggugaagaaggggaacagcuacccgaagcuguccaagagcuacaucaacgacaagggcaaggaggugcucguccugugggggauccaccaccccagcgccuccgccgaccagcagagccuguaccagaacgccgacgccuacguguucgugggcuccagccgguacuccaagaaggucaagcccgagaucgcgauccgccccaaggugcgggaccaggagggccgcaugaacuacuacuggacccucguggagccgggggacaagaucacguucgaggccaccggcaaccuggucgugccccgguacgccuucgccauggagcgcaacgccgggagcggcaucaucaucuccgacacccccgugcacgacugcaacaccacgugccagacccccaagggcgcgaucaacaccagccugccguuccagaacauccaccccaucaccaucgggaagugccccaaguacgucaaguccacgaagcuccggcuggccaccggccugcgcaacgugcccagcauccagucccggggccucuucggggccaucgccggguucaucgagggcggcuggaccgggaugguggacggcugguacggguaccaccaccagaacgagcagggcagcggguacgccgcggaccugaaguccacccagaacgccaucgacgagaucacgaacaaggucaacagcgugaucgagaagaugaacacccaguucaccgccgucggcaaggaguucaaccaccuggagaagcgcaucgagaaccucaacaagaagguggacgacggcuuccuggacaucuggaccuacaacgccgagcugcucgugcugcuggagaacgagcggacgcucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuacccgaaguacagcgaggaggcgaagcucaaccgggaggagaucgacggcgucaagcuggaguccacccgcaucuaccagauccuggccaucuacagcaccguggccagcucccucgugcuggucgugagccugggggccaucuccuucuggaugugcagcaacggcucccuccagugccggaucugcaucuga

SEQ ID NO: 68895 - RNA, 1701 nt, Artificial Sequence; identical to SEQ ID NO: 63664
  derived and/or modified sequence opt1 from hemagglutinin__InfluenzaA__AEW11263

SEQ ID NO: 68896 - RNA, 1701 nt, Artificial Sequence; identical to SEQ ID NO: 63664
  derived and/or modified sequence opt1 from hemagglutinin__InfluenzaA__AEW11273

SEQ ID NO: 68897 - RNA, 1701 nt, Artificial Sequence; identical to SEQ ID NO: 63664
  derived and/or modified sequence opt1 from hemagglutinin__InfluenzaA__AEW11283

SEQ ID NO: 68898 - RNA, 1701 nt, Artificial Sequence; identical to SEQ ID NO: 63664
  derived and/or modified sequence opt1 from hemagglutinin__InfluenzaA__AEW11293

SEQ ID NO: 68899 - RNA, 1701 nt, Artificial Sequence
  derived and/or modified sequence opt1 from hemagglutinin__InfluenzaA__AEW11303
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccgggugugcaucuga

SEQ ID NO: 68900 - RNA, 1701 nt, Artificial Sequence; identical to SEQ ID NO: 63664
  derived and/or modified sequence opt1 from hemagglutinin__InfluenzaA__AEW11313

SEQ ID NO: 68901 - RNA, 1701 nt, Artificial Sequence
  derived and/or modified sequence opt1 from hemagglutinin__InfluenzaA__AEW11323
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccgugaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacggcagccugcagugccggaucugcaucuga

SEQ ID NO: 68902 - RNA, 1701 nt, Artificial Sequence
  derived and/or modified sequence opt1 from hemagglutinin__InfluenzaA__AEW22712
augaaggccauccuggugguccuccuguacaccuucgccaccgcgaacgccgacacgcugugcaucggcuaccacgccaacaacagcaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaagggguucuacaagaaccugaucuggcucgucaagaagggcaacuccuaccccaagcugagcaaguccuacaucaacgacaaggggaaggaggugcuggugcucuggggcauccaccaccccagcaccacggccgaccagcagagccuguaccagaacgccgacaccuacgucuucgugggcaccucccgguacagcaagaaguucaagcccgagaucgccauccgcccgaaggugcgggaccaggaggggcgcaugaacuacuacuggacccuggucaagcccggcgacaagaucacguucgaggccaccgggaaccucguggugccccgguacgcguucgccauggagcgcaacgccggcuccggcaucaucaucagcgacacccccguccacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgugaucgagaagaugaacacccaguucaccgcggucggcaaggaguucaaccaccuggagaagcgcaucgagaaccugaacaagaagguggacgacggguuccucgacaucuggaccuacaacgccgagcugcugguccuccuggagaacgagcggacgcuggacuaccacgacagcaacgugaagaaccucuacgagaaggugcgcaaccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggccaucuacagcaccguggcguccagccugguccucguggugucccugggcgccaucagcuucuggaugugcagcaacggcucccugcagugccggaucugcaucuga

SEQ ID NO: 68903 - RNA, 1701 nt, Artificial Sequence
  derived and/or modified sequence opt1 from hemagglutinin__InfluenzaA__AEW22718
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccuggugaagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 68904 - RNA, 1701 nt, Artificial Sequence; identical to SEQ ID NO: 67462
  derived and/or modified sequence opt1 from hemagglutinin__InfluenzaA__AEW22720

SEQ ID NO: 68905 - RNA, 1701 nt, Artificial Sequence; identical to SEQ ID NO: 67462
  derived and/or modified sequence opt1 from hemagglutinin__InfluenzaA__AEW22722

SEQ ID NO: 68906 - RNA, 1701 nt, Artificial Sequence
  derived and/or modified sequence opt1 from hemagglutinin__InfluenzaA__AEW22724
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgcccgggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggccaucuacagcaccgucgcguccagccuggugcucguggucucccugggcgccaucagcuucuggaugugcagcaacggcucccugcagugccgcaucugcaucuga

SEQ ID NO: 68907 - RNA, 1701 nt, Artificial Sequence
  derived and/or modified sequence opt1 from hemagglutinin__InfluenzaA__AEW25297
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggaucccggggaaccccgagugcgagagccuguccaccgcgagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggccgaaccacgaccccaacaagggggucaccgccgccugcccccacgccggcgccaagagcuucuacaagaaccugaucuggcuggugaagaaggggaacuccuaccccaagcucagcaaguccuacaucaacgacaagggcaaggaggugcugguccugugggggauccaccacccgagcaccagcgccgaccagcagucccucuaccagaacgccgacgccuacguguucgugggcacgagccgguacuccaagaaguucaagcccgagaucgccauccgccccaagguccgggaccaggagggccgcaugaacuacuacuggacccugguggagcccggggacaagaucaccuucgaggcgaccggcaaccugguggucccgcgguacgccuucgccauggagcgcaacgccgggagcggcaucaucaucuccgacacgcccgugcacgacugcaacacgaccugccagacgccccggggcgccaucaacaccagccuccccuuccagaacauccacccgaucaccaucgggaagugccccaaguacgugaaguccaccaagcugcgccuggcgaccggccuccggaacguccccagcauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgugaagaaccuguacgagaagguccggagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcuggaguccacccggaucuaccagauccucgcgaucuacagcaccgucgccuccagccuggugcugguggucagccucggggccaucuccuucuggaugugcagcaacggcucccugcagugccgcaucugcaucuga

SEQ ID NO: 68908 - RNA, 1701 nt, Artificial Sequence; identical to SEQ ID NO: 64475
  derived and/or modified sequence opt1 from hemagglutinin__InfluenzaA__AEW25306

SEQ ID NO: 68909 - RNA, 1701 nt, Artificial Sequence
  derived and/or modified sequence opt1 from hemagglutinin__InfluenzaA__AEW25315
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucugggugugcagcaacggcucccugcagugccggaucugcaucuga

SEQ ID NO: 68910 - RNA, 1701 nt, Artificial Sequence
  derived and/or modified sequence opt1 from hemagglutinin__InfluenzaA__AEW25331
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagucccucuaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccagccuccccuuccagaacaucccgcccaucaccaucgggaagugccccaaguacgugaaguccaccaagcugcggcuggccaccggccuccgcaacguccccagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcagugccggaucugcaucuga

SEQ ID NO: 68911 - RNA, 1701 nt, Artificial Sequence
  derived and/or modified sequence opt1 from hemagglutinin__InfluenzaA__AEW25349
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagucccucuaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcaacggcucccugcagugccggaucugcaucuga

SEQ ID NO: 68912 - RNA, 1701 nt, Artificial Sequence
  derived and/or modified sequence opt1 from hemagglutinin__InfluenzaA__AEW25367
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagcggcucuaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggccaccggcaaccugguggucccccgcuacgcguucgccauggagcggaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcgccuggccaccggccuccggaacgugccguccauccagagccgcgggcuguucggcgcgaucgccggguucaucgagggcggcuggacggggaugguggacggcugguacggguaccaccaccagaacgagcagggcuccggguacaccgccgaccucaagagcacccagaacgccaucgacgagaucaccaacaaggugaacuccgucaucgagaagaugaacacgcaguucaccgccgugggcaaggaguucaaccaccuggagaagcggaucgagaaccugaacaagaaggucgacgacggcuuccuggacaucuggaccuacaacgcggagcuccuggugcugcucgagaacgagcgcacccuggacuaccacgacagcaacgugaagaaccuguacgagaagguccggucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagagcacccggaucuaccagauccucgccaucuacuccaccgucgccagcagccuggugcugguggucucccucggggcgaucagcuucuggaugugcuccaacggcagccugcagugccgcaucugcaucuga

SEQ ID NO: 68913 - RNA, 1701 nt, Artificial Sequence
  derived and/or modified sequence opt1 from hemagglutinin__InfluenzaA__AEW25377
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagucccagcugaagaacaacgccaaggagaucgggaacggcugcuucgaguucuaccacaagugcgacaacgccugcauggagagcgugaagaacgggacguacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68914 - RNA, 1701 nt, Artificial Sequence
  derived and/or modified sequence opt1 from hemagglutinin__InfluenzaA__AEW25385
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugcccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68915 - RNA, 1701 nt, Artificial Sequence; identical to SEQ ID NO: 68911
  derived and/or modified sequence opt1 from hemagglutinin__InfluenzaA__AEW25416

SEQ ID NO: 68916 - RNA, 1701 nt, Artificial Sequence
  derived and/or modified sequence opt1 from hemagglutinin__InfluenzaA__AEW25446
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacaagcaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68917 - RNA, 1701 nt, Artificial Sequence; identical to SEQ ID NO: 68911
  derived and/or modified sequence opt1 from hemagglutinin__InfluenzaA__AEW25454

SEQ ID NO: 68918 - RNA, 1701 nt, Artificial Sequence
  derived and/or modified sequence opt1 from hemagglutinin__InfluenzaA__AEW25462
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaagcccuacaccaacgacaagggcaaggaggugcugguccucugggggauccaccacccguccacgagcgccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggcgacgggcaaccucguggucccgcgguacgccuucgccauggagcgcaacgccggguccggcaucaucaucagcgacacccccgugcacgacugcaacacgaccugccagacccccaagggcgccaucaacaccucccugcccuuccagaacauccacccgaucaccaucgggaagugccccaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 68919 - RNA, 1701 nt, Artificial Sequence; identical to SEQ ID NO: 64475
  derived and/or modified sequence opt1 from hemagglutinin__InfluenzaA__AEW25472

SEQ ID NO: 68920 - RNA, 1701 nt, Artificial Sequence
  derived and/or modified sequence opt1 from hemagglutinin__InfluenzaA__AEW25482
augaaggccauccuggugguccuccuguacaccuucgccaccgcgaacgccgacacgcugugcaucggcuaccacgccaacaacagcaccgacaccguggacaccgugcucgagaagaaggucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccaccccuccaccagcgccgaccagcagagccuguaccagaacgccgacgccuacguguucgugggcacgucccgguacagcaagaaguucaagccggagaucgccauccgccccaagguccgggaccagggcgggcgcaugaacuacuacuggacccugguggagcccggcgacaagaucaccuucgaggcgaccgggaaccucguggucccccgguacgccuucgccauggagcgcaacgccggcuccggcaucaucaucagcgacacgccggugcacgacugcaacacgaccugccagacccccaagggggccaucaacaccucccugcccuuccagaacauccaccccaucaccaucggcaagugcccgaaguacgucaagagcaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgagcuguaccacaagugcgacaacacgugcauggagagcgugaagaacggcaccuacgacuaccccaaguacuccgaggaggccaagcucaaccgggaggagaucgacggggugaagcuggagagcacccgcaucuaccagauccuggcgaucuacuccaccgucgccagcucccucgugcugguggucagccugggcgccaucagcuucuggaugugcuccaacggcagccuccagugccggaucugcaucuga

SEQ ID NO: 68921 - RNA, 1701 nt, Artificial Sequence
  derived and/or modified sequence opt1 from hemagglutinin__InfluenzaA__AEW25492
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacaucuucgugggcacgagccgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 68922 - RNA, 1701 nt, Artificial Sequence
  derived and/or modified sequence opt1 from hemagglutinin__InfluenzaA__AEW25501
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucugccucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 68923 - RNA, 1701 nt, Artificial Sequence; identical to SEQ ID NO: 68911
  derived and/or modified sequence opt1 from hemagglutinin__InfluenzaA__AEW25509

SEQ ID NO: 68924 - RNA, 1701 nt, Artificial Sequence
  derived and/or modified sequence opt1 from hemagglutinin__InfluenzaA__AEW25519
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacaccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgcggaccagcagucccuguaccagaacgccgacgccuacguguucgugggcaccagccgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 68925 - RNA, 1701 nt, Artificial Sequence
  derived and/or modified sequence opt1 from hemagglutinin__InfluenzaA__AEW25528
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagucccucuaccagaacgccgacgccuacguguucgugggcacgagccgguacuccaagaaguucaagcccgagaucgccauccgcccgaagguccgggaccaggagcgccggaugaacuacuacuggacccugguggagcccggcgacaagaucaccuucgaggccaccgggaaccugguggucccccgcuacgcguucgccauggagcggaacgccggcagcgggaucaucaucuccgacacgcccgugcacgacugcaacacgaccugccagaccccgaagggcgccaucaacaccagccuccccuuccagaacauccaccccaucaccaucggcaagugccccaaguacgugaaguccaccaagcugcgccuggccaccgggcuccggaacgucccgagcauccagucccgcggccuguucggggcgaucgccggcuucaucgagggcggguggacgggcaugguggacgggugguacggcuaccaccaccagaacgagcaggggagcggcuacgccgccgaccugaaguccacccagaacgccaucgacgagaucaccaacaaggugaacagcgucaucgagaagaugaacacccaguucacggcgguggggaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgugaagaaccuguacgagaagguccggagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcuggaguccacccggaucuaccagauccucgccaucuacagcaccgucgcgagcucccuggugcugguggucagccucggcgccaucuccuucuggaugugcagcaacgggucccugcagugccgcaucugcaucuga

SEQ ID NO: 68926 - RNA, 1701 nt, Artificial Sequence
  derived and/or modified sequence opt1 from hemagglutinin__InfluenzaA__AEW25545
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggagcuacgacuaccccaaguacuccgaggaggccaagcugaaccgggaggagaucgacggcgugaagcucgagagcacccgcaucuaccagauccuggcgaucuacuccaccgucgccagcagccuggugaugguggucucccucggggccaucagcuucuggaugugcuccaacggcagccugcagugccggaucugcaucuga

SEQ ID NO: 68927 - RNA, 1701 nt, Artificial Sequence
  derived and/or modified sequence opt1 from hemagglutinin__InfluenzaA__AEW25555
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacuacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68928 - RNA, 1701 nt, Artificial Sequence
  derived and/or modified sequence opt1 from hemagglutinin__InfluenzaA__AEW25564
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgcccugaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaaccggaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcaccgggaucuaccagauccuggcgaucuacuccaccgucgccagcagccucgugcugguggucucccugggcgccaucagcuucuggaugugcuccaacggcagccuccagugccggaucugcaucuga

SEQ ID NO: 68929 - RNA, 1701 nt, Artificial Sequence; identical to SEQ ID NO: 64475
  derived and/or modified sequence opt1 from hemagglutinin__InfluenzaA__AEW25573

SEQ ID NO: 68930 - RNA, 1701 nt, Artificial Sequence
  derived and/or modified sequence opt1 from hemagglutinin__InfluenzaA__AEW25582
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucauccugagcgacacgcccgugcacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacgugccguccauccagagccgggggcuguucggcgccaucgccggguucaucgagggcggcuggacggggaugguggacggcugguacggguaccaccaccagaacggccagggguccggcuacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccucaacaagaaggucgacgacggguuccuggacaucuggaccuacaacgccgagcugcucgugcugcuggagaacgagcggacccucgacuaccacgacagcaacgugaagaaccuguacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgggaggagaucgacggggugaagcuggagagcacccgcaucuaccagauccuggcgaucuacuccaccgucgccagcagccucgugcugguggucucccugggcgccaucagcuucuggaugugcuccaacggcagccuccagugccggaucugcaucuga

SEQ ID NO: 68931 - RNA, 1701 nt, Artificial Sequence
  derived and/or modified sequence opt1 from hemagglutinin__InfluenzaA__AEW25590
augaaggccauccuggugguccuccuguacaccuucgccaccgcgaacgccgacacgcugugcaucggcuaccacgccaacaacagcaccgacaccguggacaccgugcucgagaagaacgucacggugacccaguccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggaggcgcgcaugaacuacuacuggacccugguggagcccggcgacaagaucaccuucgaggccaccgggaaccucguggucccccgguacgccuucgccauggagcgcgacgccggcuccgggaucaucaucagcgacacgcccgugcacgacugcaacacgaccugccagaccccgaagggcgcgaucaacaccucccugcccuuccagaacauccaccccaucaccaucggcaagugccccaaguacgucaagagcaccaagcugcggcucgccaccgggcugcgcaacgugccguccauccagagccggggccuguucggggccaucgccggcuucaucgagggcggguggacgggcaugguggacgggugguacggcuaccaccaccagaacgagcagggguccggcuacgccgcggaccucaagagcacccagaacgccaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccuccacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgggaggagaucgacggggugaagcucgagagcacccgcaucuaccagauccuggccaucuacuccaccgucgccagcagccuggugcucguggucucccugggcgccaucagcuucuggaugugcuccaacgggagccugcagugccggaucugcaucuga

SEQ ID NO: 68932 - RNA, 1701 nt, Artificial Sequence; identical to SEQ ID NO: 64475
  derived and/or modified sequence opt1 from hemagglutinin__InfluenzaA__AEW25600

SEQ ID NO: 68933 - RNA, 1701 nt, Artificial Sequence; identical to SEQ ID NO: 64475
  derived and/or modified sequence opt1 from hemagglutinin__InfluenzaA__AEW25620

SEQ ID NO: 68934 - RNA, 1701 nt, Artificial Sequence
  derived and/or modified sequence opt1 from hemagglutinin__InfluenzaA__AEW25629
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccgaggccaagagcuucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucguggggacgagccgguacuccaagaaguucaagccggagaucgccauccgccccaagguccgggaccaggagggccgcaugaacuacuacuggacccugguggagcccggcgacaagaucaccuucgaggcgaccgggaaccucguggucccccgguacgccuucgccauggagcgcaacgccggcagcgggaucaucaucuccgacacgccggugcacgacugcaacacgaccugccagacccccaagggcgccaucaacaccagccugcccuuccagaacauccaccccaucaccaucggcaagugcccgaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacaugugcauggaguccgugaagaacggcaccuacgacuaccccaaguacagcgaggaggccaagcugaaccgggaggagaucgacggggugaagcucgaguccacgcgcaucuaccagauccuggcgaucuacagcaccgucgccuccagccuggugcucguggucagccugggcgccaucuccuucuggaugugcagcaacgggucccugcagugccggaucugcaucuga

SEQ ID NO: 68935 - RNA, 1701 nt, Artificial Sequence; identical to SEQ ID NO: 63677
  derived and/or modified sequence opt1 from hemagglutinin__InfluenzaA__AEW25637

SEQ ID NO: 68936 - RNA, 1701 nt, Artificial Sequence
  derived and/or modified sequence opt1 from hemagglutinin__InfluenzaA__AEW25646
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68937 - RNA, 1701 nt, Artificial Sequence
  derived and/or modified sequence opt1 from hemagglutinin__InfluenzaA__AEW25654
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccuccccgcccuuccagaacauccaccccaucaccaucgggaagugccccaaguacgucaagagcaccaagcugcggcuggcgaccggccuccgcaacauccccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgcgaucuacuccaccguggccagcagccugguccugguggugucccucggggccaucagcuucuggaugugcuccaacggcagccugcagugccggaucugcaucuga

SEQ ID NO: 68938 - RNA, 1701 nt, Artificial Sequence
  derived and/or modified sequence opt1 from hemagglutinin__InfluenzaA__AEW25662
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaaggggaucaccgccgccugcccccacgccggcgccaagagcuucuacaagaaccugaucuggcucgucaagaaggggaacuccuaccccaagcugagcaaguccuacaucaacgacaagggcaaggaggugcuggugcucugggggauccaccaccccagcaccagcgccgaccagcagucccuguaccagaacgccgacgccuacgucuucgugggcacgagccgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 68939 - RNA, 1701 nt, Artificial Sequence
  derived and/or modified sequence opt1 from hemagglutinin__InfluenzaA__AEW25669
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggagggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68940 - RNA, 1701 nt, Artificial Sequence
  derived and/or modified sequence opt1 from hemagglutinin__InfluenzaA__AEW25678
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugcgcgccaucagcuucuggaugugcuccaacgggagccugcagugccggaucugcaucuga

SEQ ID NO: 68941 - RNA, 1701 nt, Artificial Sequence
  derived and/or modified sequence opt1 from hemagglutinin__InfluenzaA__AEW25687
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugccccuacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68942 - RNA, 1701 nt, Artificial Sequence; identical to SEQ ID NO: 68911
  derived and/or modified sequence opt1 from hemagglutinin__InfluenzaA__AEW25696

SEQ ID NO: 68943 - RNA, 1701 nt, Artificial Sequence; identical to SEQ ID NO: 64475
  derived and/or modified sequence opt1 from hemagglutinin__InfluenzaA__AEW25706

SEQ ID NO: 68944 - RNA, 1695 nt, Artificial Sequence
  derived and/or modified sequence opt1 from hemagglutinin__InfluenzaA__AEW91908
auggagaagaucgugcugcuguucgccaccaucagccuggucaaguccgaccacaucugcaucggcuaccacgccaacaacagcaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgaccucugcuaccccgggaacuucaacgacuacgaggagcugaagcaccuccucucccgcaucaaccacuucgagaagauccagaucaucccgaagaacagcugguccgaccacgaggccagccugggcguguccgcggccugccccuaccagggcaagagcuccuucuuccggaacgucguguggcugaucaagaaggacaacgccuaccccacgaucaagaagggguacaacaacaccaaccaggaggaccuccuggugcuguggggcauccaccaccccaacgacgaggccgagcagacccgccucuaccagaacccgaccacguacaucagcaucgggaccuccacccugaaccagcggcugguccccaagaucgcgacccgcagcaagaucaacggccaguccgggcggaucgacuucuucuggacgauccucaagcccaacgacgccauccacuucgagagcaacggcaacuucaucgcccccgaguacgccuacaagaucgugaagaagggcgacuccaccaucaugaaguccgagguggaguacgggaacugcaacacccgcugccagaccccgaucggcgccaucaacagcagcaugcccuuccacaacauccacccccugacgaucggggagugccccaaguacgucaagagcaacaagcuggugcucgcgaccggccugcggaacuccccgcagggcgagacccgcgggcuguucggcgccaucgccggguucaucgagggcggguggcagggcaugguggacggcugguacggguaccaccacagcaacgagcagggcuccggguacgccgccgacaaggagagcacccagaaggcgaucgacggcgucacgaacaaggugaacuccaucaucgacaagaugaacacccaguucgaggccguggggcgggaguucaacaaccucgagcgccggaucgagaaccugaacaagaagauggaggacggcuuccuggacgucuggaccuacaacgccgagcuccuggugcugauggagaacgagcgcacccucgacuuccacgacagcaacgugcggaaccuguacgacaagguccgccugcagcucaaggacaacgccaaggagcugggcaacgggugcuucgaguucuaccacaagugcgacaacgagugcauggaguccgugcggaacggcacguacgacuacccccaguacagcgaggaggcccgccugaagcgggaggagaucuccggggucaagcucgagagcaucggcaucuaccagauccuguccaucuacagcaccguggcguccagccuggugcucgccaucaugauggccgggcugucccuguggaugugcagcaacggcucccuccagugccgcaucugcaucuga

SEQ ID NO: 68945 - RNA, 1701 nt, Artificial Sequence
  derived and/or modified sequence opt1 from hemagglutinin__InfluenzaA__AEX09175
augaaggccauccuggugguccuccuguacaccuucgccaccgcgaacgccgacacgcugugcaucggcuaccacgccaacaacagcaccgacaccguggacaccgugcucgagaagaacgucgccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccgcgagggccggaugaacuacuacuggacgcugguggagcccggggacaagaucaccuucgaggccaccggcaaccucguggucccccgcuacgccuucgccauggagcggaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcgccucgccaccggccugcggaacgugccguccauccagagccgcgggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgugaagcucgagagcacccggaucuaccagauccuggccaucuacuccaccgucgccagcagccuggugcucguggucucccugggggccaucagcuucuggaugugcuccaacggcagccugcagugccgcaucugcaucuga

SEQ ID NO: 68946 - RNA, 1701 nt, Artificial Sequence; identical to SEQ ID NO: 63677
  derived and/or modified sequence opt1 from hemagglutinin__InfluenzaA__AEX25795

SEQ ID NO: 68947 - RNA, 1701 nt, Artificial Sequence
  derived and/or modified sequence opt1 from hemagglutinin__InfluenzaA__AEX25797
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68948 - RNA, 1701 nt, Artificial Sequence
  derived and/or modified sequence opt1 from hemagglutinin__InfluenzaA__AEX25798
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccacaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68949 - RNA, 1701 nt, Artificial Sequence; identical to SEQ ID NO: 63677
  derived and/or modified sequence opt1 from hemagglutinin__InfluenzaA__AEX25800

SEQ ID NO: 68950 - RNA, 1701 nt, Artificial Sequence; identical to SEQ ID NO: 63677
  derived and/or modified sequence opt1 from hemagglutinin__InfluenzaA__AEX25803

SEQ ID NO: 68951 - RNA, 1701 nt, Artificial Sequence; identical to SEQ ID NO: 63919
  derived and/or modified sequence opt1 from hemagglutinin__InfluenzaA__AEX25808

SEQ ID NO: 68952 - RNA, 1701 nt, Artificial Sequence; identical to SEQ ID NO: 66647
  derived and/or modified sequence opt1 from hemagglutinin__InfluenzaA__AEX25810

SEQ ID NO: 68953 - RNA, 1701 nt, Artificial Sequence
  derived and/or modified sequence opt1 from hemagglutinin__InfluenzaA__AEX25811
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguucaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaaggccggguccggcaucaucaucagcgacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68954 - RNA, 1701 nt, Artificial Sequence; identical to SEQ ID NO: 66647
  derived and/or modified sequence opt1 from hemagglutinin__InfluenzaA__AEX25814

SEQ ID NO: 68955 - RNA, 1701 nt, Artificial Sequence
  derived and/or modified sequence opt1 from hemagglutinin__InfluenzaA__AEX25816
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaacagcugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 68956 - RNA, 1701 nt, Artificial Sequence
  derived and/or modified sequence opt1 from hemagglutinin__InfluenzaA__AEX25818
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccagagcaccagcgccgaccagcagucccuguaccagaacgccgacgccuacguguucgugggcagcucccgguacagcaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccggguccggcaucaucaucagcgacacccccgugcacgacugcaacacgaccugccagacccccaagggcgccaucaacaccucccugccguuccacaacauccaccccaucacgaucgggaagugccccaaguacgucaagagcaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68957 - RNA, 1701 nt, Artificial Sequence
  derived and/or modified sequence opt1 from hemagglutinin__InfluenzaA__AEX25824
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacguggagagcaccaagcugcggcucgcgaccggccugcgcaacgucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 68958 - RNA, 1698 nt, Artificial Sequence
  derived and/or modified sequence opt1 from hemagglutinin__InfluenzaA__AEX33420
augaaggugaagcugcucguccugcugugcaucuucaccgccaccuacgccgacacgaucugcaucggcuaccacgcgaacaacagcaccgacaccguggacaccgugcucgagaagaacgucacggugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuaccgcaaccugcuguggcucaccggcaagagcggccuguaccccaaccuguccaagagcuacgccaacaacaaggagaaggaggugcucguccuguggggcgugcaccacccgcccaacaucggggaccagcgggcccuguaccacaccgagaacgccuacgugagcgucguguccagccacuacucccgccgguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucagccgcggguucggcuccggcaucaucaccagcaacgcccccauggacgagugcgacgcgaagugccagacgccccagggggccaucaacuccagccugcccuuccagaacguccacccggugaccaucggcgagugccccaaguacgugaaguccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcgucuaccagauccuggccaucuacagcaccguggccuccagccucgugcugcuggucucccucggggccaucagcuucuggaugugcuccaacggcagccugcagugccgcaucugcaucuga

SEQ ID NO: 68959 - RNA, 1701 nt, Artificial Sequence
  derived and/or modified sequence opt1 from hemagglutinin__InfluenzaA__AEX33453
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccgacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 68960 - RNA, 1701 nt, Artificial Sequence; identical to SEQ ID NO: 62803
  derived and/or modified sequence opt1 from hemagglutinin__InfluenzaA__AEX33464

SEQ ID NO: 68961 - RNA, 1701 nt, Artificial Sequence; identical to SEQ ID NO: 62803
  derived and/or modified sequence opt1 from hemagglutinin__InfluenzaA__AEX33475

SEQ ID NO: 68962 - RNA, 1701 nt, Artificial Sequence; identical to SEQ ID NO: 62803
  derived and/or modified sequence opt1 from hemagglutinin__InfluenzaA__AEX33486

SEQ ID NO: 68963 - RNA, 1701 nt, Artificial Sequence; identical to SEQ ID NO: 62803
  derived and/or modified sequence opt1 from hemagglutinin__InfluenzaA__AEX33497

SEQ ID NO: 68964 - RNA, 1701 nt, Artificial Sequence; identical to SEQ ID NO: 62803
  derived and/or modified sequence opt1 from hemagglutinin__InfluenzaA__AEX33508

SEQ ID NO: 68965 - RNA, 1701 nt, Artificial Sequence; identical to SEQ ID NO: 62803
  derived and/or modified sequence opt1 from hemagglutinin__InfluenzaA__AEX33519

SEQ ID NO: 68966 - RNA, 1701 nt, Artificial Sequence
  derived and/or modified sequence opt1 from hemagglutinin__InfluenzaA__AEX33541
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccagcugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcccaggcgagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggccgcgaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 68967 - RNA, 1701 nt, Artificial Sequence
  derived and/or modified sequence opt1 from hemagglutinin__InfluenzaA__AEX33574
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgacugcaucggcagcauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 68968 - RNA, 1701 nt, Artificial Sequence; identical to SEQ ID NO: 62803
  derived and/or modified sequence opt1 from hemagglutinin__InfluenzaA__AEX33585

SEQ ID NO: 68969 - RNA, 1701 nt, Artificial Sequence
  derived and/or modified sequence opt1 from hemagglutinin__InfluenzaA__AEX33596
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 68970 - RNA, 1701 nt, Artificial Sequence; identical to SEQ ID NO: 62803
  derived and/or modified sequence opt1 from hemagglutinin__InfluenzaA__AEX33618

SEQ ID NO: 68971 - RNA, 1701 nt, Artificial Sequence; identical to SEQ ID NO: 62803
  derived and/or modified sequence opt1 from hemagglutinin__InfluenzaA__AEX33629

SEQ ID NO: 68972 - RNA, 1701 nt, Artificial Sequence; identical to SEQ ID NO: 68969
  derived and/or modified sequence opt1 from hemagglutinin__InfluenzaA__AEX33640

SEQ ID NO: 68973 - RNA, 1701 nt, Artificial Sequence
  derived and/or modified sequence opt1 from hemagglutinin__InfluenzaA__AEX33836
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacaucuuccugaucaacuccaccggcaaccucaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccucaaguccacccaggcggccaucaaccagaucaacggcaagcugaaccggcugaucggcaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 68974 - RNA, 1701 nt, Artificial Sequence; identical to SEQ ID NO: 61638
  derived and/or modified sequence opt1 from hemagglutinin__InfluenzaA__AEX33880

SEQ ID NO: 68975 - RNA, 1698 nt, Artificial Sequence
  derived and/or modified sequence opt1 from hemagglutinin__InfluenzaA__AEX33913
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggagaacuccuggcccaaccacacgaccaccggggucagcgccuccugcagccacaacggcgaguccagcuucuacaagaaccugcuguggcucaccgggaagaacggccuguaccccaaccuguccaagagcuacgccaacaacaagaagaaggaggugcucgugcuguggggcguccaccacccgcccaacaucggcaaccagcgggcccuguaccacacggagaacgccuacguguccguggucagcagccacuacucccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacgagugcgacgcgaagugccagacgccccagggggccaucaacuccagccugcccuuccagaacgugcacccggucaccaucggcgagugccccaaguacgugcgcuccgccaagcugcggauggugaccgggcuccgcaacauccccagcauccagucccggggccuguucggggccaucgccggcuucaucgagggcggguggaccggcauggucgacgggugguacggcuaccaccaccagaacgagcaggggagcggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaaguucgagagcaugggcguguaccagauccucgccaucuacuccaccgucgccagcagccuggugcugcucgugucccugggggccaucagcuucuggaugugcuccaacggcagccugcagugccgcaucugcaucuga

SEQ ID NO: 68976 - RNA, 1698 nt, Artificial Sequence
  derived and/or modified sequence opt1 from hemagglutinin__InfluenzaA__AEX33924
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagagcugguccuacaucguggagaagcccagccccgagaacgggaccugcuaccccggccacuucgccgacuacgaggagcugcgggagcagcuguccagcguguccagcuucgagcgcuucgagaucuucccgaaggaguccagcuggcccaaccacacggccaccggggucuccgccagcugcucccacaacggcaagagcuccuucuacaagaaccuccuguggcugaccgggaagaacggccucuaccccaaccugagcaagagcuacgccaacaacaaggagaaggaggugcuggugcucuggggcguccaccacccgcccaacaucggcgaccagcgggcccuguaccacaccgagaacgccuacguguccguggucagcucccacuacagccgcaaguucacgcccgagaucgcgaagcggcccaaggugcgcgaccagaagggccggaucaacuacuacuggacccugcucgagcccggggacaccaucaucuucgaggccaacggcaaccugaucgccccgcgcuacgccuucgcccugucccggggguucggcagcggcaucaucaacuccaacgcgcccauggacgagugcgacgccaagugccagacgccccagggggccaucaacagcucccuccccuuccagaacgugcacccggucaccaucggcgagugccccaaguacgugcgcagcgccaagcugcggauggugaccgggcugcgcaacauccccuccauccagagccggggccucuucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccugaacaagaagguggacgacggcuucaucgacaucuggaccuacaacgcggagcuccugguccugcucgagaacgagcgcacgcuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcuggagagcaugggcguguaccagauccucgccaucuacuccaccgucgccagcucccuggugcugcucgugagccugggggccaucuccuucuggaugugcagcaacggcucccugcagugccgcaucugcaucuga

SEQ ID NO: 68977 - RNA, 1701 nt, Artificial Sequence
  derived and/or modified sequence opt1 from hemagglutinin__InfluenzaA__AEX33957
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagguggaggucacgaacgccaccgagcuggugcagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgucccggacuacgcgucccugcggagccucguggccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccagcggccgcaucaccguguccacgaagcggagccagcagaccgucaucccgaacaucgggagccgcccccgggugcgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgucaaccggaucaccuacggggccugcccccgcuacgugaagcagaacacccugaagcuggcgaccggcaugcggaacgugcccgagaagcagacgcgcgggaucuucggcgccaucgccggcuucaucgagaacgggugggagggcauggucgacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucagcgagguggagggccggauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgcuuccagaucaagggcguggagcucaagagcggguacaaggacuggauccuguggaucuccuucgccaucagcugcuuccugcucugcgucgcccugcugggcuucaucaugugggccugccagaaggggaacauccggugcaacaucugcaucuga

SEQ ID NO: 68978 - RNA, 1701 nt, Artificial Sequence
  derived and/or modified sequence opt1 from hemagglutinin__InfluenzaA__AEX33968
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccuccacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccggugcaacaucugcaucuga

SEQ ID NO: 68979 - RNA, 1701 nt, Artificial Sequence
  derived and/or modified sequence opt1 from hemagglutinin__InfluenzaA__AEX33979
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaacgggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 68980 - RNA, 1701 nt, Artificial Sequence
  derived and/or modified sequence opt1 from hemagglutinin__InfluenzaA__AEX33990
augaagaccaucaucgcccugagcuacauccucuaccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcaggacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaagagcguggagcugaaguccggguacaaggacuggauccuguggaucagcuucgccaucuccugcuuccuccugugcguggcccugcucggcuucaucaugugggccugccagaagggcaacauccggugcaacaucugcaucuga

SEQ ID NO: 68981 - RNA, 1701 nt, Artificial Sequence
  derived and/or modified sequence opt1 from hemagglutinin__InfluenzaA__AEX34001
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacagcgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcagccagcagaccgugaucccgaacaucggcucccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacgccgagggcaucgggcaggccgcggaccugaaguccacccaggccgccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 68982 - RNA, 1701 nt, Artificial Sequence
  derived and/or modified sequence opt1 from hemagglutinin__InfluenzaA__AEX34012
augaagaccaucaucgcccugagcuacauccucuaccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 68983 - RNA, 1701 nt, Artificial Sequence; identical to SEQ ID NO: 63442
  derived and/or modified sequence opt1 from hemagglutinin__InfluenzaA__AEX34023

SEQ ID NO: 68984 - RNA, 1701 nt, Artificial Sequence
  derived and/or modified sequence opt1 from hemagglutinin__InfluenzaA__AEX34044
augaagaccaucaucgccuucagcuacauccugugccucguguucgcccagaagcugcccggcaucgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcagcaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgcggcuccaacaacagcuucuucucccggcugaacuggcugacgcacagcaaguucaaguaccccgcccucaacgugaccaugcccaacaacgaggaguucgacaagcuguacaucuggggcguccaccaccccgggaccgacaacgaccagaucuuccuguacgcgcaggccuccggccgcaucaccgugagcacgaagcggagccagcagaccgugaucccgaacaucgggucccgcccccggguccgcaacauccccagccggaucuccaucuacuggaccaucgugaagcccggcgacauccuccugaucaacagcaccgggaaccugaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucgaccagaucaacggcaagcucaaccgccugaucgggaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgcuuccagaucaagggcguggagcugaaguccggguacaaggacuggauccucuggaucagcuucgccaucuccugcuuccugcugugcguggcccuccugggcuucaucaugugggccugccagaaggggaacauccggugcaacaucugcaucuga

SEQ ID NO: 68985 - RNA, 1701 nt, Artificial Sequence
  derived and/or modified sequence opt1 from hemagglutinin__InfluenzaA__AEX34089
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcuccaacagcuucuucucccggcugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccggccgcaucaccgugagcacgaagcggagccagcagaccgugaucccgaacaucgggucccgcccccggguccgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagagcacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 68986 - RNA, 1701 nt, Artificial Sequence
  derived and/or modified sequence opt1 from hemagglutinin__InfluenzaA__AEX34123
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccggugcaacaucugcaucuga

SEQ ID NO: 68987 - RNA, 1701 nt, Artificial Sequence
  derived and/or modified sequence opt1 from hemagglutinin__InfluenzaA__AEX34134
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccugaaguccacgcaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 68988 - RNA, 1701 nt, Artificial Sequence; identical to SEQ ID NO: 68986
  derived and/or modified sequence opt1 from hemagglutinin__InfluenzaA__AEX34145

SEQ ID NO: 68989 - RNA, 1701 nt, Artificial Sequence
  derived and/or modified sequence opt1 from hemagglutinin__InfluenzaA__AEX34156
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcggcagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggacguacgaccacgacgucuaccgcgacgaggcccucaacaaccgguuccagaucaagggcguggagcugaaguccggcuacaaggacuggauccuguggaucuccuucgccaucagcugcuuccuccugugcgugguccugcucggguucaucaugugggccugccagaagggcaacauccgcugcaacaucugcaucuga

SEQ ID NO: 68990 - RNA, 1701 nt, Artificial Sequence; identical to SEQ ID NO: 62936
  derived and/or modified sequence opt1 from hemagglutinin__InfluenzaA__AEX34178

SEQ ID NO: 68991 - RNA, 1701 nt, Artificial Sequence
  derived and/or modified sequence opt1 from hemagglutinin__InfluenzaA__AEX34188
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaaguucaaguaccccgcccugaacgugaccaugcccaacaacgagaacuucgacaagcuguacaucuggggcguccaccaccccgggaccgacaacgaccagaucuuccucuacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcaucgcccugcugggcuucaucaugugggccugccagaaggggaacauccgcugcaacaucugcaucuga

SEQ ID NO: 68992 - RNA, 1701 nt, Artificial Sequence; identical to SEQ ID NO: 63442
  derived and/or modified sequence opt1 from hemagglutinin__InfluenzaA__AEX34199

SEQ ID NO: 68993 - RNA, 1701 nt, Artificial Sequence
  derived and/or modified sequence opt1 from hemagglutinin__InfluenzaA__AEX34221
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccaacaacagcuucuucucccggcugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccggccgcaucaccgugagcacgaagcggagccagcagaccgugaucccgaacaucgggucccgcccccggguccgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcgacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagagcacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 68994 - RNA, 1701 nt, Artificial Sequence; identical to SEQ ID NO: 62936
  derived and/or modified sequence opt1 from hemagglutinin__InfluenzaA__AEX34243

SEQ ID NO: 68995 - RNA, 1701 nt, Artificial Sequence; identical to SEQ ID NO: 68991
  derived and/or modified sequence opt1 from hemagglutinin__InfluenzaA__AEX34254

SEQ ID NO: 68996 - RNA, 1701 nt, Artificial Sequence; identical to SEQ ID NO: 62936
  derived and/or modified sequence opt1 from hemagglutinin__InfluenzaA__AEX34265

SEQ ID NO: 68997 - RNA, 1701 nt, Artificial Sequence
  derived and/or modified sequence opt1 from hemagglutinin__InfluenzaA__AEX34275
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccuccaccccgggaccgacaacgaccagaucuuccuguacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacuacgucuaccgcgacgaggcccucaacaaccgcuuccagaucaagggcguggagcucaagagcggguacaaggacuggauccuguggaucuccuucgccaucagcugcuuccugcugugcguggcccugcucggcuucaucaugugggccugccagaaggggaacauccggugcaacaucugcaucuga

SEQ ID NO: 68998 - RNA, 1698 nt, Artificial Sequence; identical to SEQ ID NO: 63496
  derived and/or modified sequence opt1 from hemagglutinin__InfluenzaA__AEX34318

SEQ ID NO: 68999 - RNA, 1698 nt, Artificial Sequence
  derived and/or modified sequence opt1 from hemagglutinin__InfluenzaA__AEX34329
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugagcaaggaguccuggagcuacaucguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccagcugcucccacaacggcgagagcuccuucuaccgcaaccugcuguggcucaccgggaagaacggccuguaccccaaccugagcaaguccuacgccaacaacaaggagaaggagguccucgugcuguggggcgugcaccacccgcccaacaucggcgaccagaaggcccuguaccacaccgagaacgccuacgucagcguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgagggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 69000 - RNA, 1701 nt, Artificial Sequence
  derived and/or modified sequence opt1 from hemagglutinin__InfluenzaA__AEX34352
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccugaacgacaagcccuuccagaacgugaaccgcaucaccuacggggccugcccgcgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 69001 - RNA, 1701 nt, Artificial Sequence; identical to SEQ ID NO: 63442
  derived and/or modified sequence opt1 from hemagglutinin__InfluenzaA__AEX34364

SEQ ID NO: 69002 - RNA, 1701 nt, Artificial Sequence; identical to SEQ ID NO: 63442
  derived and/or modified sequence opt1 from hemagglutinin__InfluenzaA__AEX34375

SEQ ID NO: 69003 - RNA, 1701 nt, Artificial Sequence
  derived and/or modified sequence opt1 from hemagglutinin__InfluenzaA__AEX34386
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 69004 - RNA, 1701 nt, Artificial Sequence
  derived and/or modified sequence opt1 from hemagglutinin__InfluenzaA__AEX34407
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccugagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgucaagcagaacacccucaagcuggcgaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagguggaccucugguccuacaacgccgagcugcuggucgcccucgagaaccagcacaccaucgaccugacggacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaaggggguggagcugaaguccggcuacaaggacuggauccucuggaucuccuucgccaucagcugcuuccugcugugcgucgcccuccugggcuucaucaugugggccugccagaaggggaacauccgcugcaacaucugcaucuga

SEQ ID NO: 69005 - RNA, 1698 nt, Artificial Sequence
  derived and/or modified sequence opt1 from hemagglutinin__InfluenzaA__AEX34440
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaccagccgcgaguccuggagcuacaucguggagaagcccaaccccgagaacggcacgugcuaccccggccacuucgccgacuacgaggagcugcgggagcagcucuccagcguguccagcuucgagcgcuucgagaucuucccgaaggaguccagcuggcccaaccacaccaccaccggggucuccgccagcugcucccacaacggcgagagcuccuucuacaagaaccugcuguggcucacggggaagaacggccuguaccccaaccugagcaaguccuacgccaacaacaaggagaaggaggugcucgugcuguggggcguccaccacccgcccaacaucgggaaccagcgggcccuguaccacaccgagaacgccuacgugagcguggucagcucccacuacagccgcaaguucacccccgagaucgccaagcggcccaaggugcgcgaccaggagggccggaucaacuacuacuggacccuccuggagcccggggacacgaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuucaucgacaucuggaccuacaacgccgagcugcugguccuccuggagaacgagcgcacccuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacagcacggucgccagcucccuggugcuccuggugagccugggggccaucuccuucuggaugugcagcaacggcucccuccagugccgcaucugcaucuga

SEQ ID NO: 69006 - RNA, 1698 nt, Artificial Sequence; identical to SEQ ID NO: 61307
  derived and/or modified sequence opt1 from hemagglutinin__InfluenzaA__AEX34462

SEQ ID NO: 69007 - RNA, 1698 nt, Artificial Sequence
  derived and/or modified sequence opt1 from hemagglutinin__InfluenzaA__AEX34473
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccggcaagagcgggcuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugaaguccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagagcgccaucaacggcaucaccaacaaggugaacuccgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggagagcaugggcgucuaccagauccuggccaucuacuccacgguggccagcucccucgugcugcuggucagccucggggccaucuccuucuggaugugcagcaacggcucccugcagugccgcaucugcaucuga

SEQ ID NO: 69008 - RNA, 1698 nt, Artificial Sequence
  derived and/or modified sequence opt1 from hemagglutinin__InfluenzaA__AEX34495
augaaggugaagcugcucguccugcugugcaucuucaccgccaccuacgccgacacgaucugcaucggcuaccacgcgaacaacagcaccgacaccguggacaccgugcucgagaagaacgucacggugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuaccgcaaccugcuguggcucaccggcaagagcggccuguaccccaaccuguccaagagcuacgccaacaacaaggagaaggaggugcucguccuguggggcgugcaccacccgcccaacaucggggugcagcgggcccuguaccacaccgagaacgccuacgucagcgugguguccagccacuacucccgccgguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucagccgcggguucggcuccggcaucaucaccagcaacgcccccauggacgagugcgacgcgaagugccagacgccccagggggccaucaacuccagccugcccuuccagaacgugcacccggugaccaucggcgagugccccaaguacgucaaguccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuuccuggacaucuggacguacaacgccgagcugcucgugcugcuggagaacgagcgcacccucgacuuccacgacuccaacgucaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 69009 - RNA, 1698 nt, Artificial Sequence; identical to SEQ ID NO: 69008
  derived and/or modified sequence opt1 from hemagglutinin__InfluenzaA__AEX34506

SEQ ID NO: 69010 - RNA, 1698 nt, Artificial Sequence; identical to SEQ ID NO: 69008
  derived and/or modified sequence opt1 from hemagglutinin__InfluenzaA__AEX34517

SEQ ID NO: 69011 - RNA, 1698 nt, Artificial Sequence; identical to SEQ ID NO: 69008
  derived and/or modified sequence opt1 from hemagglutinin__InfluenzaA__AEX34528

SEQ ID NO: 69012 - RNA, 1698 nt, Artificial Sequence; identical to SEQ ID NO: 69008
  derived and/or modified sequence opt1 from hemagglutinin__InfluenzaA__AEX34539

SEQ ID NO: 69013 - RNA, 1698 nt, Artificial Sequence; identical to SEQ ID NO: 69008
  derived and/or modified sequence opt1 from hemagglutinin__InfluenzaA__AEX34550

SEQ ID NO: 69014 - RNA, 1698 nt, Artificial Sequence; identical to SEQ ID NO: 69008
  derived and/or modified sequence opt1 from hemagglutinin__InfluenzaA__AEX34561

SEQ ID NO: 69015 - RNA, 1698 nt, Artificial Sequence; identical to SEQ ID NO: 69008
  derived and/or modified sequence opt1 from hemagglutinin__InfluenzaA__AEX34572

SEQ ID NO: 69016 - RNA, 1698 nt, Artificial Sequence; identical to SEQ ID NO: 69008
  derived and/or modified sequence opt1 from hemagglutinin__InfluenzaA__AEX34583

SEQ ID NO: 69017 - RNA, 1698 nt, Artificial Sequence; identical to SEQ ID NO: 69008
  derived and/or modified sequence opt1 from hemagglutinin__InfluenzaA__AEX34594

SEQ ID NO: 69018 - RNA, 1698 nt, Artificial Sequence; identical to SEQ ID NO: 69008
  derived and/or modified sequence opt1 from hemagglutinin__InfluenzaA__AEX34605

SEQ ID NO: 69019 - RNA, 1698 nt, Artificial Sequence; identical to SEQ ID NO: 69008
  derived and/or modified sequence opt1 from hemagglutinin__InfluenzaA__AEX34616

SEQ ID NO: 69020 - RNA, 1698 nt, Artificial Sequence; identical to SEQ ID NO: 69008
  derived and/or modified sequence opt1 from hemagglutinin__InfluenzaA__AEX34627

SEQ ID NO: 69021 - RNA, 1698 nt, Artificial Sequence; identical to SEQ ID NO: 69008
  derived and/or modified sequence opt1 from hemagglutinin__InfluenzaA__AEX34638

SEQ ID NO: 69022 - RNA, 1698 nt, Artificial Sequence
  derived and/or modified sequence opt1 from hemagglutinin__InfluenzaA__AEX34650
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcggagccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggccaacggcaaccugaucgcgccgcgguucgccuucgcccucagccgcggguucggcuccggcaucaucacgagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggcgaucuacagcacgguggccuccagccucgugcugcuggucucccucggggccaucagcuucuggaugugcuccaacggcagccugcagugccggaucugcaucuga

SEQ ID NO: 69023 - RNA, 1698 nt, Artificial Sequence
  derived and/or modified sequence opt1 from hemagglutinin__InfluenzaA__AEX34661
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaagggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaagaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 69024 - RNA, 1698 nt, Artificial Sequence
  derived and/or modified sequence opt1 from hemagglutinin__InfluenzaA__AEX34672
augaaggugaagcugcucguccugcugugcaccuucaccgccacguacgccgacaccaucugcaucggcuaccacgcgaacaacagcaccgacaccguggacacggugcucgacaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacgacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgugcagcgggcccuguaccacacggagaacgccuacgugagcgucgugagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuucaucgacaucuggacguacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69025 - RNA, 1698 nt, Artificial Sequence
  derived and/or modified sequence opt1 from hemagglutinin__InfluenzaA__AEX34683
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccuaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguucggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggccaucuacuccaccgucgccagcagccuggugcuccuggugucccugggggccaucagcuucuggaugugcuccaacggcagccuccagugccgcaucugcaucuga

SEQ ID NO: 69026 - RNA, 1698 nt, Artificial Sequence
  derived and/or modified sequence opt1 from hemagglutinin__InfluenzaA__AEX34757
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgggagcuccuucuacaagaaccugcuguggcucacccggaagaacggccuguaccccaaccugagcaaguccuacgccaacaacaaggagaaggaggugcucgugcuguggggcguccaccacccgcccaacaucggcgaccagcgcgcccuguaccacacggagaacgccuacgugagcguggucagcucccacuacagccggaaguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccaucuccuucuggaugugcagcaacggcucccuccagugccggaucugcaucuga

SEQ ID NO: 69027 - RNA, 1698 nt, Artificial Sequence
  derived and/or modified sequence opt1 from hemagglutinin__InfluenzaA__AEX34768
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggacuccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccagggcgggcggaucaacuacuacuggacccuccuggagcccggcgacaccaucaucuucgaggcgaacgggaaccugaucgccccgcgcuacgccuucgcccucucccggggcuucggcagcgggaucaucaacuccaacgcccccauggacgagugcgacgcgaagugccagacgccccagggcgccaucaacagcucccugcccuuccagaacgugcacccggucaccaucggggagugccccaaguacgugcgcagcgccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacagcaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacagcaccgucgccagcucccuggugcuccuggugagccugggcgccaucuccuucuggaugugcagcaacgggucccuccagugccgcaucugcaucuga

SEQ ID NO: 69028 - RNA, 1698 nt, Artificial Sequence
  derived and/or modified sequence opt1 from hemagglutinin__InfluenzaA__AEX34779
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagcgcagcuucuaccggaaccugcuguggcucaccgggaagaacggccuguaccccaaccuguccaagagcuacgccaacaacaaggagaaggaggugcucguccuguggggcgugcaccacccgcccaacaucggcaaccagaaggcccuguaccacaccgagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggccagcagccuggugcuccuggucucccugggggccaucagcuucuggaugugcuccaacggcagccuccagugccgcaucugcaucuga

SEQ ID NO: 69029 - RNA, 1698 nt, Artificial Sequence; identical to SEQ ID NO: 65105
  derived and/or modified sequence opt1 from hemagglutinin__InfluenzaA__AEX34790

SEQ ID NO: 69030 - RNA, 1698 nt, Artificial Sequence
  derived and/or modified sequence opt1 from hemagglutinin__InfluenzaA__AEX34801
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacggcgccugcuaccccggccacuucgccgacuacgaggagcugcgcgagcagcucagcuccgugagcuccuucaagcgguucgagaucuucccgaaggagagcuccuggcccaaccacaccgucacgggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggggaccagaugacccuguaccacaaggagaacgccuacguguccgucgugagcagccacuacucccgcaaguucacccccgagaucgccaagcggcccaaggugcgcgaccaggagggccggaucaacuacuacuggacgcuccuggagcccggggacaccaucaucuucgaggcgagcggcaaccugaucgccccgcgcuacgccuucgcccucucccggggguucggcagcggcaucaucaacuccgacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacguguggaccuacaacgccgagcugcuggugcuccuggagaacgagcgcacccuggacuuccacgacagcaacgucaagaaccucuacgagaaggugaagaaccagcugaagaacaacgcgaaggagaucgggaacggcugcuucgaguucuaccacaagugcaacgacgagugcauggaguccgugaagaacgggacguacgacuaccccaaguacagcgaggaguccaagcugagccgggagaagaucgacggcgucaagcucgaguccaugggcguguaccagauccuggccaucuacagcaccguggccagcucccugguccuccuggugagccugggggccaucuccuucuggaugugcagcaacggcucccuccagugccgcaucugcaucuga

SEQ ID NO: 69031 - RNA, 1698 nt, Artificial Sequence
  derived and/or modified sequence opt1 from hemagglutinin__InfluenzaA__AEX34812
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucgacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 69032 - RNA, 1698 nt, Artificial Sequence
  derived and/or modified sequence opt1 from hemagglutinin__InfluenzaA__AEX34834
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaacuccaaggagagcugguccuacaucguggagaagcccaaccccgagaacgggaccugcuaccccggccacuucgccgacuacgaggagcugcgcgagcagcucagcuccgugagcuccuucaagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucaccaagcggcccaaggugcgcgaccaggagggccggaucaacuacuacuggacccuccuggagcccggggacaccaucaucuucgaggccagcggcaaccugaucgccccgcgcuacgcguucgcccucucccggggguucggcagcggcaucaucaacuccaacgcccccauggacgagugcgacgccaagugccagacgccccagggggccaucaacagcucccugcccuuccagaacguccacccggugaccaucggcgagugccccaaguacgugcgcagcgcgaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacgcagaacgcgaucaacggcaucaccaacaaggugaacagcgucaucgagaagaugaacacccaguucaccgccguggggaaggaguucaacaagcuggagcgccggauggagaaccucaacaagaaggucgacgacggcuucaucgacguguggacguacaacgccgagcugcuggugcuccuggagaacgagcgcacccuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggccaucuacagcaccguggcgagcucccugguccuccuggugagccugggggccaucuccuucuggaugugcagcaacggcucccuccagugccgcaucugcaucuga

SEQ ID NO: 69033 - RNA, 1698 nt, Artificial Sequence
  derived and/or modified sequence opt1 from hemagglutinin__InfluenzaA__AEX34845
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugcccaaggagagcugguccuacaucguggagaagcccaaccccgagaacgggaccugcuacccgggccacuucgccgacuacgaggagcugcgcgagcagcucagcuccgucagcuccuucgagcgguucgagaucuuccccaaggagagcuccuggcccaaccacacggugaccggggugagcgccuccugcagccacaacggcgaguccagcuucuaccgcaaccugcuguggcucaccgggaagaacggccuguaccccaaccuguccaagagcuacgccaacaacaaggagaaggagguccucgugcuguggggcgugcaccacccgcccaacaucggcgaccagaaggcccuguaccacaccgagaacgccuacgucuccguggugagcagccacuacucccggaaguucacgcccgagaucgccaagcgccccaagguccgggaccaggagggccgcaucaacuacuacuggacccuccuggagccgggggacaccaucaucuucgaggcgaacggcaaccugaucgcgccccgguacgccuucgcccucagccgcggguucggcuccggcaucaucaacagcaacgcccccauggacaagugcgacgccaagugccagacgccccagggggccaucaacuccagccugccguuccagaacgugcaccccgugaccaucggcgagugccccaaguacguccgguccgccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuacccgaaguacagcgaggaguccaagcugaaccgcgagaagaucgagggcgugaagcucgagagcaugggcguguaccagauccuggccaucuacuccaccguggccagcagccugguccuccuggugucccugggggccaucagcuucuggaugugcuccaacggcagccuccagugccggaucugcaucuga

SEQ ID NO: 69034 - RNA, 1698 nt, Artificial Sequence; identical to SEQ ID NO: 65105
  derived and/or modified sequence opt1 from hemagglutinin__InfluenzaA__AEX34856

SEQ ID NO: 69035 - RNA, 1698 nt, Artificial Sequence
  derived and/or modified sequence opt1 from hemagglutinin__InfluenzaA__AEX34867
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccuggugagcaaggaguccuggagcuacaucguggagaagcccaaccccgagaacgggaccugcuaccccggccacuucgccgacuacgaggagcugcgcgagcagcucaucuccgucagcuccuucgagcgguucgagaucuucccgaaggagagcuccuggcccaaccacacggugaccggggugagcgccuccugcagccacaacggcgaguccagcuucuaccgcaaccugcuguggcucaccgggaagaacggccuguaccccaaccuguccaagagcuacgccaacaacaaggagaaggagguccucgugcuguggggcgugcaccacccgcccaacaucggcgaccagaaggcccuguaccacaccgagaacgccuacgucuccguggugagcagccacuacucccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucagccgcggguucggcuccggcaucaucaacagcaacgcccccauggacaagugcgacgcgaagugccagacgccccgcggggccaucaacuccagccugcccuuccagaacgugcacccggugaccaucggcgagugccccaaguacguccgguccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggucaacagcgugaucgagaagaugaacacccaguucaccgccgucgggaaggaguucaacaagcuggagcgccggauggagaaccucaacaagaagguggacgacggcuucaucgacaucuggaccuacaacgccgagcugcuggugcuccuggagaacgagcgcacgcuggacuuccacgacuccaacgucaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgagggcgugaagcucgagagcaugggcguguaccagauccuggccaucuacuccaccguggccagcagccugguccuccuggugucccugggggccaucagcuucuggaugugcuccaacggcagccuccagugccgcaucugcaucuga

SEQ ID NO: 69036 - RNA, 1698 nt, Artificial Sequence; identical to SEQ ID NO: 65105
  derived and/or modified sequence opt1 from hemagglutinin__InfluenzaA__AEX34878

SEQ ID NO: 69037 - RNA, 1698 nt, Artificial Sequence
  derived and/or modified sequence opt1 from hemagglutinin__InfluenzaA__AEX34889
augaaggugaaccugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 69038 - RNA, 1698 nt, Artificial Sequence
  derived and/or modified sequence opt1 from hemagglutinin__InfluenzaA__AEX34900
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcgugacgaacaaggucaacagcgugaucgagaagaugaacacccaguucaccgccgucgggaaggaguucaacaagcuggagcgccggauggagaaccucaacaagaagguggacgacggcuucaucgacguguggaccuacaacgccgagcugcugguccuccuggagaacgagcgcacgcuggacuuccacgacagcaacgugaagaaccucuacgagaaggugaagaaccagcugaagaacaacgccaaggagaucgggaacggcugcuucgaguucuaccacaagugcaacgacgagugcauggaguccgucaagaacgggaccuacgacuaccccaaguacagcgaggaguccaagcugagccgggagaagaucgacggcguggagcucgaguccaugggcguguaccagauccuggcgaucuacagcaccgucgccagcucccuggugcuccuggugagccugggggccaucuccuucuggaugugcagcaacggcucccuccagugccgcaucugcaucuga

SEQ ID NO: 69039 - RNA, 1698 nt, Artificial Sequence
  derived and/or modified sequence opt1 from hemagglutinin__InfluenzaA__AEX34911
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagccaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucggcuccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 69040 - RNA, 1698 nt, Artificial Sequence
  derived and/or modified sequence opt1 from hemagglutinin__InfluenzaA__AEX34922
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggcgcuucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucgacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69041 - RNA, 1698 nt, Artificial Sequence; identical to SEQ ID NO: 63496
  derived and/or modified sequence opt1 from hemagglutinin__InfluenzaA__AEX34933

SEQ ID NO: 69042 - RNA, 1698 nt, Artificial Sequence; identical to SEQ ID NO: 63496
  derived and/or modified sequence opt1 from hemagglutinin__InfluenzaA__AEX34944

SEQ ID NO: 69043 - RNA, 1698 nt, Artificial Sequence
  derived and/or modified sequence opt1 from hemagglutinin__InfluenzaA__AEX34955
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagaaggcccuguaccacaccgagaacgccuacgugagcguggucagcucccacuacagccggaaguucacgcccgagaucgcgaagcgccccaaggugcgggaccaggagggccgcaucaacuacuacuggacccuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacaucuggaccuacaacgcggagcugcugguccuccuggagaacgagcggacgcuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccaucuccuucuggaugugcagcaacggcucccuccagugccggaucugcaucuga

SEQ ID NO: 69044 - RNA, 1698 nt, Artificial Sequence
  derived and/or modified sequence opt1 from hemagglutinin__InfluenzaA__AEX34966
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucauguucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 69045 - RNA, 1698 nt, Artificial Sequence; identical to SEQ ID NO: 69044
  derived and/or modified sequence opt1 from hemagglutinin__InfluenzaA__AEX34977

SEQ ID NO: 69046 - RNA, 1698 nt, Artificial Sequence; identical to SEQ ID NO: 69044
  derived and/or modified sequence opt1 from hemagglutinin__InfluenzaA__AEX34988

SEQ ID NO: 69047 - RNA, 1698 nt, Artificial Sequence; identical to SEQ ID NO: 65105
  derived and/or modified sequence opt1 from hemagglutinin__InfluenzaA__AEX34999

SEQ ID NO: 69048 - RNA, 1698 nt, Artificial Sequence; identical to SEQ ID NO: 69044
  derived and/or modified sequence opt1 from hemagglutinin__InfluenzaA__AEX35010

SEQ ID NO: 69049 - RNA, 1698 nt, Artificial Sequence; identical to SEQ ID NO: 69044
  derived and/or modified sequence opt1 from hemagglutinin__InfluenzaA__AEX35032

SEQ ID NO: 69050 - RNA, 1698 nt, Artificial Sequence; identical to SEQ ID NO: 69044
  derived and/or modified sequence opt1 from hemagglutinin__InfluenzaA__AEX35043

SEQ ID NO: 69051 - RNA, 1698 nt, Artificial Sequence
  derived and/or modified sequence opt1 from hemagglutinin__InfluenzaA__AEX35054
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucauguucgaggcgaacggcaaccugaucgccccgcgguacgccuucgcccucaaccgcggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 69052 - RNA, 1698 nt, Artificial Sequence; identical to SEQ ID NO: 69044
  derived and/or modified sequence opt1 from hemagglutinin__InfluenzaA__AEX35065

SEQ ID NO: 69053 - RNA, 1698 nt, Artificial Sequence; identical to SEQ ID NO: 63496
  derived and/or modified sequence opt1 from hemagglutinin__InfluenzaA__AEX35076

SEQ ID NO: 69054 - RNA, 1698 nt, Artificial Sequence
  derived and/or modified sequence opt1 from hemagglutinin__InfluenzaA__AEX35087
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucaagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 69055 - RNA, 1698 nt, Artificial Sequence
  derived and/or modified sequence opt1 from hemagglutinin__InfluenzaA__AEX35098
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucaugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccaucuccuucuggaugugcagcaacggcucccuccagugccggaucugcaucuga

SEQ ID NO: 69056 - RNA, 1698 nt, Artificial Sequence
  derived and/or modified sequence opt1 from hemagglutinin__InfluenzaA__AEX35109
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccagcccccgaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 69057 - RNA, 1698 nt, Artificial Sequence
  derived and/or modified sequence opt1 from hemagglutinin__InfluenzaA__AEX35120
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccgcgagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69058 - RNA, 1698 nt, Artificial Sequence; identical to SEQ ID NO: 68801
  derived and/or modified sequence opt1 from hemagglutinin__InfluenzaA__AEX35131

SEQ ID NO: 69059 - RNA, 1698 nt, Artificial Sequence; identical to SEQ ID NO: 68801
  derived and/or modified sequence opt1 from hemagglutinin__InfluenzaA__AEX35142

SEQ ID NO: 69060 - RNA, 1698 nt, Artificial Sequence
  derived and/or modified sequence opt1 from hemagglutinin__InfluenzaA__AEX35153
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccagcggcaaccugaucgcgccgcgcuacgccuucgcccucucccggggguucggcagcggcaucaucaacuccaacgcccccauggacgagugcgacgccaagugccagacgccccagggggcgaucaacagcaaccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacuccaacgucaagagccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 69061 - RNA, 1698 nt, Artificial Sequence
  derived and/or modified sequence opt1 from hemagglutinin__InfluenzaA__AEX35164
augaaggugaagcugcucguccugcugugcgccuucaccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacagccggaaguucacccccgagaucgcgaagcgccccaagguccgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacgcaguucaccgccgucgggaaggaguucaacaagcuggagcggcgcauggagaaccucaacaagaagguggacgacggcuucaucgacaucuggaccuacaacgcggagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 69062 - RNA, 1698 nt, Artificial Sequence
  derived and/or modified sequence opt1 from hemagglutinin__InfluenzaA__AEX35175
augaaggugaagcugcucguccugcugugcaccuucaccgccacguacgccgacaccaucugcaucggcuaccacgcgaacaacagcaccgacaccguggacacggugcucgagaagaacgucaccgugacccacuccguggaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccggggugaccgccuccugcagccacaacggcaaguccagcuucuaccgcaaccugcuguggcucacggggaagaacggccuguaccccaaccuguccaagagcuacgccaacaacaaggagaaggaggugcucguccuguggggcgugcaccacccgcccaacaucggggaccagcgggcccuguaccacaccgagaacgccuacguguccgucgugagcagccacuacucccgccgguucacccccgagaucgccaagcgccccaaggugcgggaccaggagggccgcaucaacuacuacuggacccuccuggagcccggggacacgaucaucuucgaggcgaacggcaaccugaucgccccgcgguucgccuucgcccucaaccgcggguucggcagcggcaucaucaccuccaacgcccccauggacgggugcgacgcgaagugccagacgccccagggcgccaucaacagcucccugcccuuccagaacguccacccggugaccaucggggagugccccaaguacgugcggagcgccaagcugcgcauggccaccggccuccggaacauccccuccauccagagccgcgggcuguucggcgccaucgcgggcuucaucgagggcggguggaccgggauggucgacggcugguacggguaccaccaccagaacgagcagggcuccggcuacgccgccgaccagaaguccacccagaacgccaucaacgggaucaccaacaaggugaacagcgugaucgagaagaugaacacgcaguucaccgccgucggcaaggaguucagcaagcuggagcggcgcauggagaaccucaacaagaagguggacgacggguuccuggacaucuggaccuacaacgcggagcugcucguccugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagagcauggggguguaccagauccuggccaucuacuccaccgucgccagcagccucgugcugcuggugucccucggcgccaucagcuucuggaugugcuccaacgggagccugcagugccggaucugcaucuga

SEQ ID NO: 69063 - RNA, 1698 nt, Artificial Sequence
  derived and/or modified sequence opt1 from hemagglutinin__InfluenzaA__AEX35186
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcaaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacagcaccgucgccagcucccuggugcuccuggugagccugggggccaucuccuucuggaugugcagcaacggcucccuccagugccgcaucugcaucuga

SEQ ID NO: 69064 - RNA, 1698 nt, Artificial Sequence; identical to SEQ ID NO: 69063
  derived and/or modified sequence opt1 from hemagglutinin__InfluenzaA__AEX35197

SEQ ID NO: 69065 - RNA, 1698 nt, Artificial Sequence; identical to SEQ ID NO: 63496
  derived and/or modified sequence opt1 from hemagglutinin__InfluenzaA__AEX35208

SEQ ID NO: 69066 - RNA, 1701 nt, Artificial Sequence
  derived and/or modified sequence opt1 from hemagglutinin__InfluenzaA__AEX35219
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgggugaccguguccaccaagcgcagccagcagaccgucaucccgaacaucggcucccggcccugggugcgcgacgugagcucccggaucagcaucuacuggacgaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccauguccugcuuccugcugugcgugguccuccugggcuucaucaugugggccugccagaaggggaacauccgcugcaacaucugcaucuga

SEQ ID NO: 69067 - RNA, 1698 nt, Artificial Sequence; identical to SEQ ID NO: 69008
  derived and/or modified sequence opt1 from hemagglutinin__InfluenzaA__AEX35230

SEQ ID NO: 69068 - RNA, 1701 nt, Artificial Sequence; identical to SEQ ID NO: 62905
  derived and/or modified sequence opt1 from hemagglutinin__InfluenzaA__AEX35241

SEQ ID NO: 69069 - RNA, 1698 nt, Artificial Sequence; identical to SEQ ID NO: 69008
  derived and/or modified sequence opt1 from hemagglutinin__InfluenzaA__AEX35263

SEQ ID NO: 69070 - RNA, 1698 nt, Artificial Sequence; identical to SEQ ID NO: 69008
  derived and/or modified sequence opt1 from hemagglutinin__InfluenzaA__AEX35274

SEQ ID NO: 69071 - RNA, 1701 nt, Artificial Sequence; identical to SEQ ID NO: 62803
  derived and/or modified sequence opt1 from hemagglutinin__InfluenzaA__AEX35285

SEQ ID NO: 69072 - RNA, 1701 nt, Artificial Sequence; identical to SEQ ID NO: 68969
  derived and/or modified sequence opt1 from hemagglutinin__InfluenzaA__AEX35296

SEQ ID NO: 69073 - RNA, 1701 nt, Artificial Sequence
  derived and/or modified sequence opt1 from hemagglutinin__InfluenzaA__AEX35307
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaagagcuucuucucccgccugaacuggcugacgcaccucaaguacaaguaccccgcccugaacgugaccaugcccaacaacgagaaguucgacaagcuguacaucuggggcguccaccaccccgggaccgacagcgaccagaucucccucuacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcugaucaacagcaccggcaaccucaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcuggccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccucgagaaguacguggaggacacgaagaucgaccuguggagcuacaacgccgagcugcucgucgcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 69074 - RNA, 1701 nt, Artificial Sequence; identical to SEQ ID NO: 68969
  derived and/or modified sequence opt1 from hemagglutinin__InfluenzaA__AEX35318

SEQ ID NO: 69075 - RNA, 1701 nt, Artificial Sequence
  derived and/or modified sequence opt1 from hemagglutinin__InfluenzaA__AEX35329
augaagaccaucaucgcccugagcuacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 69076 - RNA, 1701 nt, Artificial Sequence
  derived and/or modified sequence opt1 from hemagglutinin__InfluenzaA__AEX35340
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 69077 - RNA, 1701 nt, Artificial Sequence; identical to SEQ ID NO: 68969
  derived and/or modified sequence opt1 from hemagglutinin__InfluenzaA__AEX35351

SEQ ID NO: 69078 - RNA, 1701 nt, Artificial Sequence; identical to SEQ ID NO: 68969
  derived and/or modified sequence opt1 from hemagglutinin__InfluenzaA__AEX35362

SEQ ID NO: 69079 - RNA, 1701 nt, Artificial Sequence; identical to SEQ ID NO: 62803
  derived and/or modified sequence opt1 from hemagglutinin__InfluenzaA__AEX35373

SEQ ID NO: 69080 - RNA, 1701 nt, Artificial Sequence
  derived and/or modified sequence opt1 from hemagglutinin__InfluenzaA__AEX35384
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugagcgugaccaugcccaacaacgagaaguucgacaagcucuacaucuggggcguccaccaccccgggaccgacaacgaccagaucucccuguacgcgcaggccagcggccggaucaccgugagcacgaagcgcucccagcagaccgugaucccgaacaucggcagccggacccgcguccgggacgugcccucccgcaucagcaucuacuggaccaucgugaagcccggggacauccugcucaucaacuccacgggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 69081 - RNA, 1701 nt, Artificial Sequence
  derived and/or modified sequence opt1 from hemagglutinin__InfluenzaA__AEX35395
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaaguggaaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccgggcggaucaccgugagcacgaagcgcagccagcagaccgugaucccgaacaucggcucccggccccgcguccgggacgugcccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 69082 - RNA, 1701 nt, Artificial Sequence; identical to SEQ ID NO: 62803
  derived and/or modified sequence opt1 from hemagglutinin__InfluenzaA__AEX35406

SEQ ID NO: 69083 - RNA, 1701 nt, Artificial Sequence; identical to SEQ ID NO: 62803
  derived and/or modified sequence opt1 from hemagglutinin__InfluenzaA__AEX35417

SEQ ID NO: 69084 - RNA, 1701 nt, Artificial Sequence
  derived and/or modified sequence opt1 from hemagglutinin__InfluenzaA__AEX35428
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaagaagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccgacaagagcuucuucucccgccucaacuggcugcaccagcugaaguacaaguaccccgcgcucaacgugaccaugcccaacaacgagaaguucgacaagcuguacaucuggggcguccaccaccccgggacggacagcgaccagaucucccuguacgcccaggccagcggccggaucaccgugagcaccaagcgcucccagcagaccgugaucccgaacaucggcagccggccccgcguccgggacguguccagccgcaucuccaucuacuggacgaucgugaagcccggggacauccucuucaucaacagcaccggcaaccugaucgcgccccggggguacuucaagauccgcuccggcaagagcuccaucaugcggagcgacgccccgaucgacaagugcaacuccgagugcaucacccccaacggcagcauccccaacgacaagcccuuccagaacgucaaccgcaucaccuacggggccugcccgcgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacuccgaggggaccggccaggccgcggaccugaaguccacgcaggccgccaucaaccagaucaacgggaagcugaaccggcucaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucacggacuccgagaugaacaagcuguucgagcggaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggcgugccagaaggggaacauccggugcaacaucugcaucuga

SEQ ID NO: 69085 - RNA, 1698 nt, Artificial Sequence
  derived and/or modified sequence opt1 from hemagglutinin__InfluenzaA__AEX35439
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 69086 - RNA, 1701 nt, Artificial Sequence
  derived and/or modified sequence opt1 from hemagglutinin__InfluenzaA__AEX35450
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagaacuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcucccagcagaccgugaucccgaacaucggcagccggccccgcguccggaacauccccagccgcaucuccaucuacuggaccaucgugaagcccggggacauccugcucaucaacagcaccggcaaccugaucgccccgcggggguacuucaagauccaguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 69087 - RNA, 1701 nt, Artificial Sequence; identical to SEQ ID NO: 61638
  derived and/or modified sequence opt1 from hemagglutinin__InfluenzaA__AEX35461

SEQ ID NO: 69088 - RNA, 1701 nt, Artificial Sequence
  derived and/or modified sequence opt1 from hemagglutinin__InfluenzaA__AEX35472
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacgacuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 69089 - RNA, 1701 nt, Artificial Sequence; identical to SEQ ID NO: 61638
  derived and/or modified sequence opt1 from hemagglutinin__InfluenzaA__AEX35483

SEQ ID NO: 69090 - RNA, 1701 nt, Artificial Sequence
  derived and/or modified sequence opt1 from hemagglutinin__InfluenzaA__AEX35494
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggccugcagaacaagaagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcgugacccagaacgggaccuccagcgccugcaagcgccgguccaacaacagcuucuucucccgccucaacuggcugacgcaccugaaguucaaguaccccgcccucaacgugaccaugcccaacaacgagaaguucgacaagcuguacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccuccugaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccucaagcuggcgaccgggaugcgcaacgugcccgagaagcagacgcggggcaucuucggggccaucgccggcuucaucgagaacggcugggaggggaugauggacggcugguacggguuccgccaccagaacagcgagggcaucgggcaggccgccgaccugaaguccacccaggcggccaucaaccagaucaacggcaagcucaaccggcugaucggcaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 69091 - RNA, 1701 nt, Artificial Sequence
  derived and/or modified sequence opt1 from hemagglutinin__InfluenzaA__AEX35505
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacgacuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccugagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucaaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 69092 - RNA, 1701 nt, Artificial Sequence
  derived and/or modified sequence opt1 from hemagglutinin__InfluenzaA__AEX35516
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggccugcagaacaagaagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcgugacccagaacgggaccuccagcgccugcaagcgccgguccaacaacagcuucuucucccgccucaacuggcugacgcaccugaaguucaaguaccccgcccucaacgugaccaugcccaacaacgagaaguucgacaagcuguacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccuccugaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccucaagcuggcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcucaaccggcugaucggcaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 69093 - RNA, 1701 nt, Artificial Sequence
  derived and/or modified sequence opt1 from hemagglutinin__InfluenzaA__AEX35527
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucagccuguacgcccaggcguccggccggaucaccgugagcacgaagcgcagccagcagaccgucaucccgaacaucggcucccggccccgcgugcgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69094 - RNA, 1701 nt, Artificial Sequence
  derived and/or modified sequence opt1 from hemagglutinin__InfluenzaA__AEX35549
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgcggcuccaacaacagcuucuucucccggcugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccggcaagaucaccgucagcacgaagcgcagccagcagaccgugaucccgaacaucgggucccggccccgcgugcgggacauccccagccgcaucuccaucuacuggaccaucgucaagcccggcgacauccugcucaucaacagcaccgggaaccugaucgccccgcggggcuacuucaagauccgcuccggcaagagcuccaucaugcggagcgacgcccccaucgacaagugcaacuccgagugcaucacgcccaacgggagcauccccaacgacaagccguuccagaacgugaacaagaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 69095 - RNA, 1701 nt, Artificial Sequence
  derived and/or modified sequence opt1 from hemagglutinin__InfluenzaA__AEX35560
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucagccuguacgcccaggcguccggccggaucaccgugagcacgaagcgcagccagcagaccgucaucccgaacaucggcucccggccccgcgugcgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgugggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 69096 - RNA, 1701 nt, Artificial Sequence
  derived and/or modified sequence opt1 from hemagglutinin__InfluenzaA__AEX35571
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagccgggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69097 - RNA, 1701 nt, Artificial Sequence; identical to SEQ ID NO: 61638
  derived and/or modified sequence opt1 from hemagglutinin__InfluenzaA__AEX35582

SEQ ID NO: 69098 - RNA, 1701 nt, Artificial Sequence
  derived and/or modified sequence opt1 from hemagglutinin__InfluenzaA__AEX35593
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcgccccugggcaagugcaacagcgagugcaucacgcccaacggguccauccccaacgacaagccguuccagaacgugaaccgcaucaccuacggcgccugcccccgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcucaaccggcugaucggcaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 69099 - RNA, 1701 nt, Artificial Sequence; identical to SEQ ID NO: 63380
  derived and/or modified sequence opt1 from hemagglutinin__InfluenzaA__AEX35604

SEQ ID NO: 69100 - RNA, 1701 nt, Artificial Sequence
  derived and/or modified sequence opt1 from hemagglutinin__InfluenzaA__AEX35615
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacaucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69101 - RNA, 1701 nt, Artificial Sequence; identical to SEQ ID NO: 63442
  derived and/or modified sequence opt1 from hemagglutinin__InfluenzaA__AEX35626

SEQ ID NO: 69102 - RNA, 1701 nt, Artificial Sequence
  derived and/or modified sequence opt1 from hemagglutinin__InfluenzaA__AEX35637
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccgacaacagcuucuucuccaagcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccagcggccggaucaccguguccacgaagcgcagccagcagaccgugauccccaacaucgggagccggccccgcguccggaacauccccucccgcaucagcaucuacuggaccaucgugaagccgggcgacauccugcugaucaacuccaccgggaaccucaucgcgccccggggcuacuucaagauccgcagcggcaaguccagcaucaugcgguccgacgcccccaucgggaagugcaacagcgagugcaucacgcccaacggcuccaucccgaacgacaagcccuuccagaacgugaaccgcaucaccuacggggccugcccccgguacgucaagcagaacacccugaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccucaaguccacccaggcggccaucaaccagaucaacggcaagcugaaccggcugaucgggaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccggugcaacaucugcaucuga

SEQ ID NO: 69103 - RNA, 1701 nt, Artificial Sequence; identical to SEQ ID NO: 63442
  derived and/or modified sequence opt1 from hemagglutinin__InfluenzaA__AEX35648

SEQ ID NO: 69104 - RNA, 1701 nt, Artificial Sequence
  derived and/or modified sequence opt1 from hemagglutinin__InfluenzaA__AEX36102
augaagaccaucaucgcccugagcuacauccucugccugguguucgcccagaagcugcccggcaacaacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69105 - RNA, 1701 nt, Artificial Sequence; identical to SEQ ID NO: 62923
  derived and/or modified sequence opt1 from hemagglutinin__InfluenzaA__AEX36113

SEQ ID NO: 69106 - RNA, 1701 nt, Artificial Sequence; identical to SEQ ID NO: 63442
  derived and/or modified sequence opt1 from hemagglutinin__InfluenzaA__AEX36124

SEQ ID NO: 69107 - RNA, 1701 nt, Artificial Sequence
  derived and/or modified sequence opt1 from hemagglutinin__InfluenzaA__AEX36146
augaagaccaucaucgcccugagcuacauccucugccuggugcuggcccagaagcuccccggcgacgacaacuccaccgcgacgcugugccuggggcaccacgccgucccgaacggcaccaucgugaagaccaucaccaacgaccagaucgaggugacgaacgccaccgagcucguccagagcuccagcaccggggagaucugcgacagcccccaccagauccuggacggcgagaacugcacccugaucgacgcccuccugggggacccccagugcgacggcuuccagaacaagaagugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaacaacagcuucuucucccgccucaacuggcugacgcaccugaaguucaaguaccccgcccucaacgugaccaugcccaacaacgagcaguucgacaagcuguacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccuccugaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 69108 - RNA, 1701 nt, Artificial Sequence
  derived and/or modified sequence opt1 from hemagglutinin__InfluenzaA__AEX36168
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgcggcuccgacaacagcuucuucucccggcugaacuggcucacccaccugaaguucaaguaccccgcgcugaacgugacgaugcccaacaacgaggaguucgacaagcucuacaucuggggcguccaccaccccgggaccgacaacgaccagaucuuccuguacgcccaggccagcggccgcaucaccguguccaccaagcggagccagcagacggugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgggaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacagcgaggggaucggccaggccgcggaccugaaguccacgcaggccgccaucgaccagaucaacggcaagcugaacaagcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacgucuaccgggacgaggcccucaacaaccgcuucaagaucaagggcguggagcugaaguccggguacaaggacuggauccuguggaucuccuucgccaucagcugcuuccuccugugcguggcccugcucggcuucaucaugugggcgugccagaaggggaacaucaagugcaacaucugcaucuga

SEQ ID NO: 69109 - RNA, 1701 nt, Artificial Sequence; identical to SEQ ID NO: 63442
  derived and/or modified sequence opt1 from hemagglutinin__InfluenzaA__AEX36179

SEQ ID NO: 69110 - RNA, 1701 nt, Artificial Sequence; identical to SEQ ID NO: 68991
  derived and/or modified sequence opt1 from hemagglutinin__InfluenzaA__AEX36190

SEQ ID NO: 69111 - RNA, 1701 nt, Artificial Sequence; identical to SEQ ID NO: 68986
  derived and/or modified sequence opt1 from hemagglutinin__InfluenzaA__AEX36201

SEQ ID NO: 69112 - RNA, 1701 nt, Artificial Sequence
  derived and/or modified sequence opt1 from hemagglutinin__InfluenzaA__AEX36212
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagaucagccagcagaccgugaucccgaacaucgggagccggccccgcguccggaacauccccucccgcaucagcaucuacuggaccaucgugaagcccggcgacauccugcugaucaacuccaccgggaaccucaucgccccgcggggcuacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccucaaguccacccaggcggccaucgaccagaucaacggcaagcugaaccggcugaucgggaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccgcugcaacaucugcaucuga

SEQ ID NO: 69113 - RNA, 1701 nt, Artificial Sequence; identical to SEQ ID NO: 68986
  derived and/or modified sequence opt1 from hemagglutinin__InfluenzaA__AEX36223

SEQ ID NO: 69114 - RNA, 1701 nt, Artificial Sequence
  derived and/or modified sequence opt1 from hemagglutinin__InfluenzaA__AEX36234
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccgacaacagcuucuucuccaagcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucgggagccggccccgcguccggaacauccccucccgcaucagcaucuacuggaccaucgugaagcccggcgacauccugcucaucaacuccaccgggaaccugaucgccccgcggggcuacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccugaaguccacccaggcggccaucaaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugccucaagaucuaccacaagugcgacaacgcgugcaucggguccauccggaacggcaccuacgaccacgacgucuaccgcgacgaggcccugaacaaccgcuuccagaucaagggcguggagcugaaguccggguacaaggacuggauccucuggaucuccuucgccaucagcugcuuccugcugugcguggcccuccugggcuucaucaugugggccugccagaaggggaacauccggugcaacaucugcaucuga

SEQ ID NO: 69115 - RNA, 1701 nt, Artificial Sequence
  derived and/or modified sequence opt1 from hemagglutinin__InfluenzaA__AEX36245
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaagacguacagcaacugcuaccccuacgacgugccggacuacgccucccugcggagccucgucgcguccagcgggacccuggaguucaacaacgaguccuucaacuggaccggcgugacccagaacgggacgagcuccgccugcaagcgcggcagcaacaacuccuucuucagccggcugaacuggcucacccacuccaaguucaaguaccccgcccugaacgugaccaugcccaacaacgaggaguucgacaagcuguacaucuggggcguccaccaccccgggaccgacaacgaccagaucuuccucuacgcccaggcgagcggccgcaucacgguguccaccaagcggagccagcagaccgugaucccgaacaucgggagccgcccccggguccgcaacauccccucccggaucagcaucuacuggaccaucgugaagcccggcgacauccugcugaucaacuccacggggaaccucaucgccccgcgcggcuacuucaagauccggagcggcaaguccagcaucaugcgcuccgacgcccccaucgggaagugcaacagcgagugcaucacccccaacggcuccauccccaacgacaagccguuccagaacgugaaccggaucaccuacggggccugcccccgcuacgucaagcagaacacccugaagcuggccacgggcaugcggaacgugcccgagaagcagacccgcgggaucuucggcgcgaucgccggcuucaucgagaacgggugggagggcaugguggacgggugguacggcuuccggcaccagaacagcgaggggaucggccaggccgccgaccucaaguccacccaggccgcgaucgaccagaucaacggcaagcugaaccgccugaucgggaagaccaacgagaaguuccaccagaucgagaaggaguucagcgaggucgagggccggauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgcgagaacgccgaggacauggggaacggcugcuucaagaucuaccacaagugcgacaacgccugcaucggguccauccggaacggcacguacgaccacgacgucuaccgcgacgaggcgcugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccggugcaacaucugcaucuga

SEQ ID NO: 69116 - RNA, 1701 nt, Artificial Sequence
  derived and/or modified sequence opt1 from hemagglutinin__InfluenzaA__AEX36256
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgcaaguccaacaacagcuucuucucccggcugaacuggcucacccaccugaaguucaaguaccccgcccugaacgugaccaugcccaacaacgagcaguucgacaagcucuacaucuggggcguccaccaccccgggaccgacaacgaccagaucuuccuguacgcccaggcgagcgggcgcaucacgguguccaccaagcggagccagcagaccgugaucccgaacaucggcagccgcccccggguccgcaacauccccucccggaucagcaucuacuggaccaucgugaagcccggcgacauccugcucaucaacuccacggggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgccacgggcaugcggaacgugcccgagaagcagacccgcgggaucuucggcgcgaucgccggguucaucgagaacggcugggagggcaugguggacgggugguacggcuuccggcaccagaacagcgaggggcgcggccaggccgccgaccugaaguccacccaggccgcgaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69117 - RNA, 1701 nt, Artificial Sequence; identical to SEQ ID NO: 68986
  derived and/or modified sequence opt1 from hemagglutinin__InfluenzaA__AEX36267

SEQ ID NO: 69118 - RNA, 1701 nt, Artificial Sequence
  derived and/or modified sequence opt1 from hemagglutinin__InfluenzaA__AEX36289
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagaucagccagcagaccgugaucccgaacaucgggagccggccccgcguccggaacauccccucccgcaucagcaucuacuggaccaucgugaagcccggcgacauccugcugaucaacuccaccgggaaccucaucgccccgcggggcuacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggcuucaucgagaacgggugggagggcaugguggacgggugguacggcuaccgccaccagaacagcgaggggaucggccaggccgccgaccucaaguccacccaggcggccaucgaccagaucaacggcaagcugaaccggcugaucgggaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagcugggguacaaggacuggauccuguggaucagcuucgccaucuccugcuuccuccugugcguggcccugcucggcuucaucaugugggccugccagaaggggaacauccgcugcaacaucugcaucuga

SEQ ID NO: 69119 - RNA, 1701 nt, Artificial Sequence
  derived and/or modified sequence opt1 from hemagglutinin__InfluenzaA__AEX36300
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucuccaacgagagcuucaacuggaccggcgugacccagaacgggaccuccagcgccugcaagcgcggcuccaacaacagcuucuucuccaagcugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccggccggaucaccgugagcacgaagcgcagccagcagaccgugaucccgaacaucgggucccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggcuucaucgagaacgggugggagggcaugguggacgggugguacggcuuccgccaccagaacuccgaggggaucggccaggccgccgaccucaagagcacccaggcggccaucgaccagaucaacggcaagcugaaccggcugaucgggaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccgcugcaacaucugcaucuga

SEQ ID NO: 69120 - RNA, 1701 nt, Artificial Sequence
  derived and/or modified sequence opt1 from hemagglutinin__InfluenzaA__AEX36311
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgcggcuccaacaacagcuucuucucccggcugaacuggcucacccaccugaaguucaaguaccccgcgcugaacgugacgaugcccaacaacgaggaguucgacaagcucuacaucuggggcguccaccaccccgggaccgacaacgaccagaucuuccuguacgcccaggccagcggccgcaucaccguguccaccaagcggagccagcagacggugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgggaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacagcgaggggaucggccaggccgcggaccugaaguccacgcaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacgucuaccgcgacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaaggggaacauccggugcaacaucugcaucuga

SEQ ID NO: 69121 - RNA, 1701 nt, Artificial Sequence
  derived and/or modified sequence opt1 from hemagglutinin__InfluenzaA__AEX36322
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuucccguacgcgcaggccagcggccgcaucaccguguccacgaagaucagccagcagaccgugauccccaacaucgggagccggccccgcguccggaacauccccucccgcaucagcaucuacuggaccaucgugaagccgggcgacauccuccugaucaacuccaccgggaaccugaucgcgccccggggcuacuucaagauccgcagcggcaaguccagcaucaugcgguccgacgcccccaucgggaagugcaacagcgagugcaucacgcccaacggcuccaucccgaacgacaagcccuuccagaacgugaaccgcaucaccuacggggccugcccccgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccugaaguccacccaggcggccaucgaccagaucaacggcaagcucaaccggcugaucgggaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagagcggguacaaggacuggauccuguggaucuccuucgccaucagcugcuuccugcugugcaucgcccuccugggcuucaucaugugggccugccagaaggggaacauccgcugcaacaucugcaucuga

SEQ ID NO: 69122 - RNA, 1701 nt, Artificial Sequence
  derived and/or modified sequence opt1 from hemagglutinin__InfluenzaA__AEX36333
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgccuaccgcgacgaggcccugaacaaccgcuuccagaucaagggcgucgagcucaagagcggguacaaggacuggauccuguggaucuccuucgccaucagcugcuuccugcucugcguggcccugcugggcuucaucaugugggcgugccagaaggggaacauccggugcaacaucugcaucuga

SEQ ID NO: 69123 - RNA, 1701 nt, Artificial Sequence
  derived and/or modified sequence opt1 from hemagglutinin__InfluenzaA__AEX36344
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaacgccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgcggcuccaacaacagcuucuucucccggcugaacuggcucacccaccugaaguucaaguaccccgcgcugaacgugacgaugcccaacaacgaggaguucgacaagcucuacaucuggggcguccaccaccccgggaccgacaacgaccagaucuuccuguacgcccaggccagcggccgcaucaccguguccaccaagcggagccagcagacggugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgggaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacagcgaggggaucggccaggccgcggaccugaaguccacgcaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucgaguccauccggaacgggaccuacgaccacgacgucuaccgcgacgaggcccucaacaaccgcuuccagaucaagggcguggagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 69124 - RNA, 1701 nt, Artificial Sequence
  derived and/or modified sequence opt1 from hemagglutinin__InfluenzaA__AEX36366
augaagaccaucaucgcccugagcuacauccucugccugguguucgcccagaagcuguccggcaacgacaacagcaccgcgacgcucugccuggggcaccacgccguccccaacggcaccaucgugaagaccaucaccaacgaccagaucgaggugacgaacgccaccgagcugguccaguccagcuccaccggggagaucugcgacagcccgcaccagauccucgacggcgagaacugcacccugaucgacgcccugcucggggacccccagugcgacggcuuccagaacaagaagugggaccuguucguggagcgcuccaaggccuacagcaacugcuaccccuacgacgugcccgacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguacccggcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcagccagcagaccgugauccccaacaucggcucccggccgcgcguccggaacauccccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 69125 - RNA, 1701 nt, Artificial Sequence; identical to SEQ ID NO: 62936
  derived and/or modified sequence opt1 from hemagglutinin__InfluenzaA__AEX36377

SEQ ID NO: 69126 - RNA, 1701 nt, Artificial Sequence
  derived and/or modified sequence opt1 from hemagglutinin__InfluenzaA__AEX36388
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugauggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69127 - RNA, 1701 nt, Artificial Sequence
  derived and/or modified sequence opt1 from hemagglutinin__InfluenzaA__AEX36399
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagacggaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69128 - RNA, 1701 nt, Artificial Sequence
  derived and/or modified sequence opt1 from hemagglutinin__InfluenzaA__AEX36410
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 69129 - RNA, 1701 nt, Artificial Sequence; identical to SEQ ID NO: 63442
  derived and/or modified sequence opt1 from hemagglutinin__InfluenzaA__AEX36421

SEQ ID NO: 69130 - RNA, 1701 nt, Artificial Sequence
  derived and/or modified sequence opt1 from hemagglutinin__InfluenzaA__AEX36432
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccaggugcucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 69131 - RNA, 1701 nt, Artificial Sequence
  derived and/or modified sequence opt1 from hemagglutinin__InfluenzaA__AEX36443
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69132 - RNA, 1701 nt, Artificial Sequence
  derived and/or modified sequence opt1 from hemagglutinin__InfluenzaA__AEX36454
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcgugguccugcucggcuucaucaugugggccugccagaaggggaacauccgcugcaacaucugcaucuga

SEQ ID NO: 69133 - RNA, 1701 nt, Artificial Sequence; identical to SEQ ID NO: 62737
  derived and/or modified sequence opt1 from hemagglutinin__InfluenzaA__AEX36465

SEQ ID NO: 69134 - RNA, 1701 nt, Artificial Sequence
  derived and/or modified sequence opt1 from hemagglutinin__InfluenzaA__AEX36476
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccaacaacagcuucuucucccggcugaacuggcucacgcacagcaaguucaaguaccccgcccugaacgugaccaugcccaacaacgaggaguucgacaagcuguacaucuggggcguccaccaccccgggaccgacaacgaccagaucuucccguacgcgcaggccuccggccgcaucaccgugagcacgaagcggagccagcagaccgugauccccaacaucgggucccgcccccggauccgcaacauccccagccggaucuccaucuacuggaccaucgucaagccgggcgacauccuccugaucaacagcaccgggaaccugaucgcgccccgcggcuacuucaagauccgguccggcaagagcuccaucaugcgcagcgacgcccccaucgggaagugcgacuccgagugcaucacgcccaacggcagcaucccgaacgacaagcccuuccagaacgugaaccggaucaccuacggggccugcccccgcuacgugaagcagaacacccucaagcuggccaccggcaugcggaacguccccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucgaccagaucaacggcaagcucaaccgccugaucgggaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgcuuccagaucaagggcgucgagcugaaguccggguacaaggacuggauccucuggaucagcuucgccaucuccugcuuccugcugugcguggcccuccugggcuucaucaugugggccugccagaaggggaacauccggugcaacaucugcaucuga

SEQ ID NO: 69135 - RNA, 1701 nt, Artificial Sequence
  derived and/or modified sequence opt1 from hemagglutinin__InfluenzaA__AEX36487
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccaacaacagcuucuucucccggcugaacuggcucacgcacagcaaguucaaguaccccgcccugaacgugaccaugcccaacaacgaggaguucgacaagcuguacaucuggggcguccuccaccccgggaccgacaacgaccagaucuuccuguacgcgcaggccuccggccgcaucaccgugagcacgaagcggagccagcagaccgugaucccgaacaucgggucccgcccccggguccgcaacauccccagccggaucuccaucuacuggaccaucgugaagcccggcgacauccugcucaucaacagcaccgggaaccugaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 69136 - RNA, 1701 nt, Artificial Sequence; identical to SEQ ID NO: 68986
  derived and/or modified sequence opt1 from hemagglutinin__InfluenzaA__AEX36498

SEQ ID NO: 69137 - RNA, 1701 nt, Artificial Sequence
  derived and/or modified sequence opt1 from hemagglutinin__InfluenzaA__AEX36509
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuucccguacgcgcaggccagcggccgcaucaccguguccacgaagcggagccagcagaccgugauccccaacaucgggagccgcccccggguccgcaacauccccucccggaucagcaucuacuggaccaucgugaagccgggcgacauccuccugaucaacuccaccgggaaccugaucgcgccccgcggcuacuucaagauccggagcggcaaguccagcaucaugcgcuccgacgcccccaucgggaagugcaacagcgagugcaucacgcccaacggcuccaucccgaacgacaagcccuuccagaacgugaaccggaucaccuacggggccugcccccgcuacgucaagcagaacacccucaagcuggccaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucgaccagaucaacggcaagcucaaccgccugaucgggaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagagcggguacaaggacuggauccuguggaucuccuucgccaucagcugcuuccugcugugcguggcccuccugggcuucaucaugugggccugccagaaggggaacauccggugcaacaucugcaucuga

SEQ ID NO: 69138 - RNA, 1701 nt, Artificial Sequence
  derived and/or modified sequence opt1 from hemagglutinin__InfluenzaA__AEX36520
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacaacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 69139 - RNA, 1701 nt, Artificial Sequence
  derived and/or modified sequence opt1 from hemagglutinin__InfluenzaA__AEX36531
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggacaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 69140 - RNA, 1701 nt, Artificial Sequence
  derived and/or modified sequence opt1 from hemagglutinin__InfluenzaA__AEX36542
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 69141 - RNA, 1701 nt, Artificial Sequence; identical to SEQ ID NO: 69140
  derived and/or modified sequence opt1 from hemagglutinin__InfluenzaA__AEX36553

SEQ ID NO: 69142 - RNA, 1701 nt, Artificial Sequence; identical to SEQ ID NO: 69140
  derived and/or modified sequence opt1 from hemagglutinin__InfluenzaA__AEX36564

SEQ ID NO: 69143 - RNA, 1701 nt, Artificial Sequence
  derived and/or modified sequence opt1 from hemagglutinin__InfluenzaA__AEX36575
augaagaccaucaucgcccugagcuacauccucugccugguguucgcccagaagcugcccggcaacgggaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgacaucugguccuacaacgccgagcugcucguggcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 69144 - RNA, 1701 nt, Artificial Sequence
  derived and/or modified sequence opt1 from hemagglutinin__InfluenzaA__AEX36586
augaagaccaucaucgcccugagcuacauccucugccugguguucgcccagaagcugcccggcaacgacaacaacaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 69145 - RNA, 1701 nt, Artificial Sequence
  derived and/or modified sequence opt1 from hemagglutinin__InfluenzaA__AEX36597
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagguggaccugugguccuacaacgccgagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 69146 - RNA, 1701 nt, Artificial Sequence
  derived and/or modified sequence opt1 from hemagglutinin__InfluenzaA__AEX36608
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagaacuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcucccagcagaccgugaucccgaacaucggcagccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaagcgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 69147 - RNA, 1701 nt, Artificial Sequence; identical to SEQ ID NO: 68969
  derived and/or modified sequence opt1 from hemagglutinin__InfluenzaA__AEX36619

SEQ ID NO: 69148 - RNA, 1701 nt, Artificial Sequence
  derived and/or modified sequence opt1 from hemagglutinin__InfluenzaA__AEX63617
auggaggccaagcuguucguccucuucugcgccuucaccgcgcugaaggccgacaccaucugcgugggcuaccacgccaacaacagcacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacagcugguccuacaucaucgagaccagcaacuccaagaacggcgcgugcuaccccggcgaguucgccgacuacgaggagcugaaggagcagcugagcaccgucuccagcuucgagcgcuucgagaucuuccccaaggccacguccuggcccaaccacgacaccacccgggggaccacgguggccugcagccacuccggcgcgaacagcuucuaccgcaaccuccuguggaucgugaagaaggggaacuccuacccgaagcugagcaaguccuacaccaacaacaagggcaaggagguccucgugaucuggggcgugcaccacccgcccaccgacagcguccagcagacccuguaccagaacaaccacacguacguguccguggggagcagcaaguacuacaagcgguucacccccgagaucgucgcccgccccaaggugcgggagcaggccggccgcaugaacuacuacuggacccugcucgaccagggggacaccaucacguucgaggccaccggcaaccugaucgcccccuggcacgcguucgcccugaagaagggguccagcuccggcaucaugcggagcgacgcccaggugcacaacugcaccaccaagugccagacgccccacggcgcccucaaggggaaccugcccuuccagaacguccacccggugaccaucggcgagugccccaaguacgugaaguccacccagcugcgcauggccaccgggcuccggaacauccccagcauccagucccgcggccuguucggggcgaucgccggcuucaucgagggcggguggacgggcauggucgacgggugguacggcuaccaccaccggaacgagcaggggagcggcuacgccgccgaccagaaguccacccagaucgccaucgacggcaucagcaacaaggugaacuccgugaucgagaagaugaacauccaguucaccagcgucgggaaggaguucaacucccuggagaagcgcauggagaaccucaacaagaagguggacgacggcuuccuggacgucuggaccuacaacgcggagcugcucauccugcuggagaacgagcggacgcucgacuuccacgaccugaacgugaagaaccuguacgagaaggucaagagccagcuccgcaacaacgccaaggagaucgggaacggcugcuucgaguucuaccacaagugcgacaacgagugcauggaguccgugaagaacgggaccuacaacuaccugaaguacagcgaggaguccaagcugaaccgggaggagaucgacggcgugaagcucgagagcaugggcauccaccagauccuggccaucuacuccaccguggccagcagccugguccuccuggugucccugggggccaucagcuucuggaugugcuccaacggcagccuccagugccgcgugugcaucuga

SEQ ID NO: 69149 - RNA, 1698 nt, Artificial Sequence; identical to SEQ ID NO: 64286
  derived and/or modified sequence opt1 from hemagglutinin__InfluenzaA__AEX92873

SEQ ID NO: 69150 - RNA, 1701 nt, Artificial Sequence; identical to SEQ ID NO: 64841
  derived and/or modified sequence opt1 from hemagglutinin__InfluenzaA__AEY69088

SEQ ID NO: 69151 - RNA, 1701 nt, Artificial Sequence; identical to SEQ ID NO: 64438
  derived and/or modified sequence opt1 from hemagglutinin__InfluenzaA__AEY69098

SEQ ID NO: 69152 - RNA, 1701 nt, Artificial Sequence; identical to SEQ ID NO: 64419
  derived and/or modified sequence opt1 from hemagglutinin__InfluenzaA__AEY69120

SEQ ID NO: 69153 - RNA, 1701 nt, Artificial Sequence; identical to SEQ ID NO: 64621
  derived and/or modified sequence opt1 from hemagglutinin__InfluenzaA__AEY69131

SEQ ID NO: 69154 - RNA, 1701 nt, Artificial Sequence; identical to SEQ ID NO: 67996
  derived and/or modified sequence opt1 from hemagglutinin__InfluenzaA__AEY69153

SEQ ID NO: 69155 - RNA, 1701 nt, Artificial Sequence; identical to SEQ ID NO: 64621
  derived and/or modified sequence opt1 from hemagglutinin__InfluenzaA__AEY69164

SEQ ID NO: 69156 - RNA, 1701 nt, Artificial Sequence; identical to SEQ ID NO: 64621
  derived and/or modified sequence opt1 from hemagglutinin__InfluenzaA__AEY69175

SEQ ID NO: 69157 - RNA, 1701 nt, Artificial Sequence; identical to SEQ ID NO: 64621
  derived and/or modified sequence opt1 from hemagglutinin__InfluenzaA__AEY69186

SEQ ID NO: 69158 - RNA, 1701 nt, Artificial Sequence; identical to SEQ ID NO: 64621
  derived and/or modified sequence opt1 from hemagglutinin__InfluenzaA__AEY69197

SEQ ID NO: 69159 - RNA, 1701 nt, Artificial Sequence; identical to SEQ ID NO: 64621
  derived and/or modified sequence opt1 from hemagglutinin__InfluenzaA__AEY69208

SEQ ID NO: 69160 - RNA, 1701 nt, Artificial Sequence; identical to SEQ ID NO: 64621
  derived and/or modified sequence opt1 from hemagglutinin__InfluenzaA__AEY69219

SEQ ID NO: 69161 - RNA, 1701 nt, Artificial Sequence; identical to SEQ ID NO: 64419
  derived and/or modified sequence opt1 from hemagglutinin__InfluenzaA__AEY69258

SEQ ID NO: 69162 - RNA, 1701 nt, Artificial Sequence; identical to SEQ ID NO: 64621
  derived and/or modified sequence opt1 from hemagglutinin__InfluenzaA__AEY69269

SEQ ID NO: 69163 - RNA, 1701 nt, Artificial Sequence; identical to SEQ ID NO: 64419
  derived and/or modified sequence opt1 from hemagglutinin__InfluenzaA__AEY69291

SEQ ID NO: 69164 - RNA, 1701 nt, Artificial Sequence; identical to SEQ ID NO: 64419
  derived and/or modified sequence opt1 from hemagglutinin__InfluenzaA__AEY69302

SEQ ID NO: 69165 - RNA, 1701 nt, Artificial Sequence; identical to SEQ ID NO: 64419
  derived and/or modified sequence opt1 from hemagglutinin__InfluenzaA__AEY69313

SEQ ID NO: 69166 - RNA, 1701 nt, Artificial Sequence; identical to SEQ ID NO: 64419
  derived and/or modified sequence opt1 from hemagglutinin__InfluenzaA__AEY69785

SEQ ID NO: 69167 - RNA, 1701 nt, Artificial Sequence
  derived and/or modified sequence opt1 from hemagglutinin__InfluenzaA__AEY69807
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggccugcagaacaagaagugggaccuguucguggagcgcuccaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaagaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccuccugaucaacuccaccgggaaccugaucgccccgcggggcuacuucaagcuccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 69168 - RNA, 1701 nt, Artificial Sequence; identical to SEQ ID NO: 64621
  derived and/or modified sequence opt1 from hemagglutinin__InfluenzaA__AEY69818

SEQ ID NO: 69169 - RNA, 1701 nt, Artificial Sequence; identical to SEQ ID NO: 64621
  derived and/or modified sequence opt1 from hemagglutinin__InfluenzaA__AEY69829

SEQ ID NO: 69170 - RNA, 1701 nt, Artificial Sequence; identical to SEQ ID NO: 64621
  derived and/or modified sequence opt1 from hemagglutinin__InfluenzaA__AEY69840

SEQ ID NO: 69171 - RNA, 1701 nt, Artificial Sequence; identical to SEQ ID NO: 64621
  derived and/or modified sequence opt1 from hemagglutinin__InfluenzaA__AEY69851

SEQ ID NO: 69172 - RNA, 1701 nt, Artificial Sequence; identical to SEQ ID NO: 64621
  derived and/or modified sequence opt1 from hemagglutinin__InfluenzaA__AEY69873

SEQ ID NO: 69173 - RNA, 1701 nt, Artificial Sequence; identical to SEQ ID NO: 64621
  derived and/or modified sequence opt1 from hemagglutinin__InfluenzaA__AEY69884

SEQ ID NO: 69174 - RNA, 1701 nt, Artificial Sequence; identical to SEQ ID NO: 64621
  derived and/or modified sequence opt1 from hemagglutinin__InfluenzaA__AEY69895

SEQ ID NO: 69175 - RNA, 1701 nt, Artificial Sequence; identical to SEQ ID NO: 67996
  derived and/or modified sequence opt1 from hemagglutinin__InfluenzaA__AEY69906

SEQ ID NO: 69176 - RNA, 1701 nt, Artificial Sequence; identical to SEQ ID NO: 64621
  derived and/or modified sequence opt1 from hemagglutinin__InfluenzaA__AEY69917

SEQ ID NO: 69177 - RNA, 1701 nt, Artificial Sequence
  derived and/or modified sequence opt1 from hemagglutinin__InfluenzaA__AEY69939
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcggcugcaucacgcccaacggguccauccccaacgacaagccguuccagaacgugaaccgcaucaccuacggcgugugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacugguuccuguggaucuccuucgccaucagcugcuuccugcucugcguggcccugcugggguucaucaugugggccugccagaagggcaacauccggugcaacaucugcaucuga

SEQ ID NO: 69178 - RNA, 1701 nt, Artificial Sequence; identical to SEQ ID NO: 69177
  derived and/or modified sequence opt1 from hemagglutinin__InfluenzaA__AEY69950

SEQ ID NO: 69179 - RNA, 1701 nt, Artificial Sequence; identical to SEQ ID NO: 69177
  derived and/or modified sequence opt1 from hemagglutinin__InfluenzaA__AEY69961

SEQ ID NO: 69180 - RNA, 1701 nt, Artificial Sequence
  derived and/or modified sequence opt1 from hemagglutinin__InfluenzaA__AEY69994
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcggcugcaucacgcccaacggguccauccccaacgacaagccguuccagaacgugaaccgcaucaccuacggcgcgugcccccgguacgugaagcagaacacccugaagcuggccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggcuacaaggacugguuccuguggaucuccuucgccaucagcugcuuccugcucugcguggcccugcugggguucaucaugugggcgugccagaagggcaacauccggugcaacaucugcaucuga

SEQ ID NO: 69181 - RNA, 1701 nt, Artificial Sequence; identical to SEQ ID NO: 69180
  derived and/or modified sequence opt1 from hemagglutinin__InfluenzaA__AEY70005

SEQ ID NO: 69182 - RNA, 1701 nt, Artificial Sequence; identical to SEQ ID NO: 64621
  derived and/or modified sequence opt1 from hemagglutinin__InfluenzaA__AEY70016

SEQ ID NO: 69183 - RNA, 1701 nt, Artificial Sequence
  derived and/or modified sequence opt1 from hemagglutinin__InfluenzaA__AEY70256
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacggcaacugcuaccccuacgacgugccggacuacgcgucccugcggagccucgucgccuccagcgggacgcuggaguucaacaacgaguccuucaacuggaccggcgugacccagaacgggaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcagaccgccaucccgaacaucggcagccggccccgcgugcggaacauccccagccgcaucuccaucuacuggaccaucgucaagcccggggacaugcugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggccgggggcaggccgcggaccugaaguccacccaggccgccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 69184 - RNA, 1701 nt, Artificial Sequence; identical to SEQ ID NO: 64621
  derived and/or modified sequence opt1 from hemagglutinin__InfluenzaA__AEY70267

SEQ ID NO: 69185 - RNA, 1701 nt, Artificial Sequence; identical to SEQ ID NO: 64621
  derived and/or modified sequence opt1 from hemagglutinin__InfluenzaA__AEY70278

SEQ ID NO: 69186 - RNA, 1701 nt, Artificial Sequence; identical to SEQ ID NO: 64419
  derived and/or modified sequence opt1 from hemagglutinin__InfluenzaA__AEY70289

SEQ ID NO: 69187 - RNA, 1701 nt, Artificial Sequence; identical to SEQ ID NO: 64621
  derived and/or modified sequence opt1 from hemagglutinin__InfluenzaA__AEY70300

SEQ ID NO: 69188 - RNA, 1701 nt, Artificial Sequence; identical to SEQ ID NO: 64621
  derived and/or modified sequence opt1 from hemagglutinin__InfluenzaA__AEY70311

SEQ ID NO: 69189 - RNA, 1701 nt, Artificial Sequence; identical to SEQ ID NO: 64621
  derived and/or modified sequence opt1 from hemagglutinin__InfluenzaA__AEY70333

SEQ ID NO: 69190 - RNA, 1701 nt, Artificial Sequence; identical to SEQ ID NO: 69180
  derived and/or modified sequence opt1 from hemagglutinin__InfluenzaA__AEY70344

SEQ ID NO: 69191 - RNA, 1701 nt, Artificial Sequence; identical to SEQ ID NO: 66232
  derived and/or modified sequence opt1 from hemagglutinin__InfluenzaA__AEY70355

SEQ ID NO: 69192 - RNA, 1701 nt, Artificial Sequence; identical to SEQ ID NO: 64419
  derived and/or modified sequence opt1 from hemagglutinin__InfluenzaA__AEY70365

SEQ ID NO: 69193 - RNA, 1701 nt, Artificial Sequence; identical to SEQ ID NO: 64621
  derived and/or modified sequence opt1 from hemagglutinin__InfluenzaA__AEY70376

SEQ ID NO: 69194 - RNA, 1701 nt, Artificial Sequence
  derived and/or modified sequence opt1 from hemagglutinin__InfluenzaA__AFB18656
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgcggccagcucccugguccucguggugagccugggcgccaucuccuucuggaugugcagcaacggcagccugcagugccggaucugcaucuga

SEQ ID NO: 69195 - RNA, 1701 nt, Artificial Sequence; identical to SEQ ID NO: 68058
  derived and/or modified sequence opt1 from hemagglutinin__InfluenzaA__AFB40597

SEQ ID NO: 69196 - RNA, 1701 nt, Artificial Sequence; identical to SEQ ID NO: 68058
  derived and/or modified sequence opt1 from hemagglutinin__InfluenzaA__AFB40598

SEQ ID NO: 69197 - RNA, 1701 nt, Artificial Sequence
  derived and/or modified sequence opt1 from hemagglutinin__InfluenzaA__AFB40599
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgaccugaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 69198 - RNA, 1701 nt, Artificial Sequence; identical to SEQ ID NO: 64841
  derived and/or modified sequence opt1 from hemagglutinin__InfluenzaA__AFB40600

SEQ ID NO: 69199 - RNA, 1701 nt, Artificial Sequence
  derived and/or modified sequence opt1 from hemagglutinin__InfluenzaA__AFB40601
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccgagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 69200 - RNA, 1701 nt, Artificial Sequence; identical to SEQ ID NO: 63677
  derived and/or modified sequence opt1 from hemagglutinin__InfluenzaA__AFB40602

SEQ ID NO: 69201 - RNA, 1701 nt, Artificial Sequence; identical to SEQ ID NO: 64841
  derived and/or modified sequence opt1 from hemagglutinin__InfluenzaA__AFB40603

SEQ ID NO: 69202 - RNA, 1701 nt, Artificial Sequence
  derived and/or modified sequence opt1 from hemagglutinin__InfluenzaA__AFB40604
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaaggaggggaacagcuaccccaagcuguccaagagcuacaucaacgacaagggcaaggaggugcugguccucugggggauccaccacccgcccaccacggccgaccagcagagccuguaccagaacgccgacaccuacguguucgugggcaccucccgguacagcaagaaguucaagcccgagaucgccauccgccccaagguccgggaccaggagggccgcaugaacuacuacuggacccugguggagcccggggacaagaucacguucgaggccaccggcaaccucguggucccccgguacgcguucgccauggagcgcaacgccggguccggcaucaucaucagcgacaccccggugcacgacugcaacaccacgugccagacccccaagggcgccaucaacaccucccugcccuuccagaacauccaccccaucaccaucgggaagugcccgaaguacgucaagagcacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcgguggacaaggaguucaaccaccuggagaagcgcaucggcaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucucccugggggccaucagcuucuggaugugcagcaacggcucccugcagugccggaucugcaucuga

SEQ ID NO: 69203 - RNA, 1701 nt, Artificial Sequence; identical to SEQ ID NO: 63677
  derived and/or modified sequence opt1 from hemagglutinin__InfluenzaA__AFB70138

SEQ ID NO: 69204 - RNA, 1701 nt, Artificial Sequence
  derived and/or modified sequence opt1 from hemagglutinin__InfluenzaA__AFB70145
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 69205 - RNA, 1701 nt, Artificial Sequence
  derived and/or modified sequence opt1 from hemagglutinin__InfluenzaA__AFB70154
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 69206 - RNA, 1701 nt, Artificial Sequence; identical to SEQ ID NO: 63677
  derived and/or modified sequence opt1 from hemagglutinin__InfluenzaA__AFB70156

SEQ ID NO: 69207 - RNA, 1701 nt, Artificial Sequence; identical to SEQ ID NO: 63677
  derived and/or modified sequence opt1 from hemagglutinin__InfluenzaA__AFB70158

SEQ ID NO: 69208 - RNA, 1701 nt, Artificial Sequence; identical to SEQ ID NO: 69204
  derived and/or modified sequence opt1 from hemagglutinin__InfluenzaA__AFB70160

SEQ ID NO: 69209 - RNA, 1701 nt, Artificial Sequence; identical to SEQ ID NO: 64871
  derived and/or modified sequence opt1 from hemagglutinin__InfluenzaA__AFB70162

SEQ ID NO: 69210 - RNA, 1701 nt, Artificial Sequence
  derived and/or modified sequence opt1 from hemagglutinin__InfluenzaA__AFB70167
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccaugcgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 69211 - RNA, 1701 nt, Artificial Sequence; identical to SEQ ID NO: 63677
  derived and/or modified sequence opt1 from hemagglutinin__InfluenzaA__AFB70177

SEQ ID NO: 69212 - RNA, 1701 nt, Artificial Sequence; identical to SEQ ID NO: 64246
  derived and/or modified sequence opt1 from hemagglutinin__InfluenzaA__AFB70187

SEQ ID NO: 69213 - RNA, 1701 nt, Artificial Sequence; identical to SEQ ID NO: 64871
  derived and/or modified sequence opt1 from hemagglutinin__InfluenzaA__AFB70197

SEQ ID NO: 69214 - RNA, 1701 nt, Artificial Sequence; identical to SEQ ID NO: 63677
  derived and/or modified sequence opt1 from hemagglutinin__InfluenzaA__AFB70207

SEQ ID NO: 69215 - RNA, 1701 nt, Artificial Sequence; identical to SEQ ID NO: 63677
  derived and/or modified sequence opt1 from hemagglutinin__InfluenzaA__AFB70217

SEQ ID NO: 69216 - RNA, 1701 nt, Artificial Sequence; identical to SEQ ID NO: 63677
  derived and/or modified sequence opt1 from hemagglutinin__InfluenzaA__AFB70227

SEQ ID NO: 69217 - RNA, 1701 nt, Artificial Sequence
  derived and/or modified sequence opt1 from hemagglutinin__InfluenzaA__AFB70247
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaaggaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 69218 - RNA, 1701 nt, Artificial Sequence
  derived and/or modified sequence opt1 from hemagglutinin__InfluenzaA__AFB70257
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucguggacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 69219 - RNA, 1701 nt, Artificial Sequence; identical to SEQ ID NO: 68084
  derived and/or modified sequence opt1 from hemagglutinin__InfluenzaA__AFB70267

SEQ ID NO: 69220 - RNA, 1701 nt, Artificial Sequence; identical to SEQ ID NO: 64147
  derived and/or modified sequence opt1 from hemagglutinin__InfluenzaA__AFB70277

SEQ ID NO: 69221 - RNA, 1701 nt, Artificial Sequence; identical to SEQ ID NO: 63677
  derived and/or modified sequence opt1 from hemagglutinin__InfluenzaA__AFB70287

SEQ ID NO: 69222 - RNA, 1701 nt, Artificial Sequence; identical to SEQ ID NO: 63677
  derived and/or modified sequence opt1 from hemagglutinin__InfluenzaA__AFB70297

SEQ ID NO: 69223 - RNA, 1701 nt, Artificial Sequence; identical to SEQ ID NO: 63677
  derived and/or modified sequence opt1 from hemagglutinin__InfluenzaA__AFB70307

SEQ ID NO: 69224 - RNA, 1701 nt, Artificial Sequence; identical to SEQ ID NO: 69204
  derived and/or modified sequence opt1 from hemagglutinin__InfluenzaA__AFB70317

SEQ ID NO: 69225 - RNA, 1701 nt, Artificial Sequence
  derived and/or modified sequence opt1 from hemagglutinin__InfluenzaA__AFB70327
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccugggcaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 69226 - RNA, 1701 nt, Artificial Sequence; identical to SEQ ID NO: 63677
  derived and/or modified sequence opt1 from hemagglutinin__InfluenzaA__AFB70337

SEQ ID NO: 69227 - RNA, 1701 nt, Artificial Sequence; identical to SEQ ID NO: 65647
  derived and/or modified sequence opt1 from hemagglutinin__InfluenzaA__AFB70347

SEQ ID NO: 69228 - RNA, 1701 nt, Artificial Sequence; identical to SEQ ID NO: 63677
  derived and/or modified sequence opt1 from hemagglutinin__InfluenzaA__AFB70367

SEQ ID NO: 69229 - RNA, 1701 nt, Artificial Sequence; identical to SEQ ID NO: 63677
  derived and/or modified sequence opt1 from hemagglutinin__InfluenzaA__AFB70377

SEQ ID NO: 69230 - RNA, 1701 nt, Artificial Sequence; identical to SEQ ID NO: 64246
  derived and/or modified sequence opt1 from hemagglutinin__InfluenzaA__AFB70387

SEQ ID NO: 69231 - RNA, 1701 nt, Artificial Sequence; identical to SEQ ID NO: 63677
  derived and/or modified sequence opt1 from hemagglutinin__InfluenzaA__AFB70397

SEQ ID NO: 69232 - RNA, 1701 nt, Artificial Sequence; identical to SEQ ID NO: 63677
  derived and/or modified sequence opt1 from hemagglutinin__InfluenzaA__AFB70407

SEQ ID NO: 69233 - RNA, 1701 nt, Artificial Sequence
  derived and/or modified sequence opt1 from hemagglutinin__InfluenzaA__AFB77618
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccaccacgaccggcgaccagcagagccuguaccagaacgccgacggcuacgucuucguggggaccacccgguacuccaagaaguucaagcccgagaucggcauccgcccgaaggugaaggaccaggaggggcggaugaacuacuacuggacgcuggucgagcccggcgacaagaucaccuucgaggccaccggcaaccucguggugccccgcuacgccuucgccauggagcggaacgcggggagcggcaucaucaucuccgacacccccguccacgacugcaacacgaccugccagaccccgaagggggccaucaacaccagccugcccuuccagaacauccaccccaucacgaucggcaagugccccaaguacgugaaguccaccaagcugcgccucgccaccgggcugcggaacgugccgagcauccagucccgcggccuguucggcgccaucgccggguucaucgagggcggguggaccggcauggucgacgggugguacggcuaccaccaccagaacgagcagggcagcggguacgcggccgaccucaaguccacgcagaacgccaucgacaagaucaccaacaaggugaacagcgugaucgagaagaugaacacccaguucaccgccgucggcaaggaguucaaccaccuggagaagcggaucgagaaccugaacaagaagguggacgacggguuccucgacaucuggacguacaacgccgagcugcugguccuccuggagaacgagcgcacccuggacuaccacgacuccaacgugaagaaccucuacgagaaggugcggaaccagcugaagaacaacgcgaaggagaucggcaacgggugcuucgaguucuaccacaagugcgacaacacgugcauggagagcgucaagaacggcaccuacgacuaccccaaguacuccgaggaggccaagcugaaccgcgaggagaucgacggcgugaagcucgagagcacccggaucuaccagauccuggccaucuacuccaccguggccagcucccuggucaugguggugagccucggggccaucuccuucuggaugugcagcaacggcagccugcagugccgcaucugcaucuga

SEQ ID NO: 69234 - RNA, 1701 nt, Artificial Sequence; identical to SEQ ID NO: 67875
  derived and/or modified sequence opt1 from hemagglutinin__InfluenzaA__AFB77619

SEQ ID NO: 69235 - RNA, 1701 nt, Artificial Sequence; identical to SEQ ID NO: 67875
  derived and/or modified sequence opt1 from hemagglutinin__InfluenzaA__AFB77620

SEQ ID NO: 69236 - RNA, 1701 nt, Artificial Sequence
  derived and/or modified sequence opt1 from hemagglutinin__InfluenzaA__AFB77621
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgcggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 69237 - RNA, 1701 nt, Artificial Sequence
  derived and/or modified sequence opt1 from hemagglutinin__InfluenzaA__AFB77622
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucaccaucgggaagugcccgaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 69238 - RNA, 1701 nt, Artificial Sequence; identical to SEQ ID NO: 67875
  derived and/or modified sequence opt1 from hemagglutinin__InfluenzaA__AFB77623

SEQ ID NO: 69239 - RNA, 1701 nt, Artificial Sequence; identical to SEQ ID NO: 67875
  derived and/or modified sequence opt1 from hemagglutinin__InfluenzaA__AFB77624

SEQ ID NO: 69240 - RNA, 1701 nt, Artificial Sequence
  derived and/or modified sequence opt1 from hemagglutinin__InfluenzaA__AFB77625
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 69241 - RNA, 1701 nt, Artificial Sequence
  derived and/or modified sequence opt1 from hemagglutinin__InfluenzaA__AFB77627
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuucagcaagaccuccagcuggcccaaccacgacuccaacaagggggucaccgccgccugcccccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccacggccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucgccauggagcgcaacgccggguccggcaucaucaucagcgacacccccgugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 69242 - RNA, 1701 nt, Artificial Sequence; identical to SEQ ID NO: 67875
  derived and/or modified sequence opt1 from hemagglutinin__InfluenzaA__AFB77628

SEQ ID NO: 69243 - RNA, 1701 nt, Artificial Sequence
  derived and/or modified sequence opt1 from hemagglutinin__InfluenzaA__AFB77629
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgaggagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgccagcucccuggugcucguggucagccugggggcgaucagcuucuggaugugcuccaacggcagccugcagugccggaucugcaucuga

SEQ ID NO: 69244 - RNA, 1701 nt, Artificial Sequence
  derived and/or modified sequence opt1 from hemagglutinin__InfluenzaA__AFB77630
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 69245 - RNA, 1701 nt, Artificial Sequence
  derived and/or modified sequence opt1 from hemagglutinin__InfluenzaA__AFB77631
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 69246 - RNA, 1701 nt, Artificial Sequence
  derived and/or modified sequence opt1 from hemagglutinin__InfluenzaA__AFB77632
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccugaccaccgcguccagcugguccuacaucguggagacgagcuccagcgacaacgggaccugcuaccccggcgacuucaucaacuacgaggagcuccgggagcagcuguccagcguguccagcuucgagcgcuucgagaucuuccccaagaccuccagcuggcccaaccacgacuccaacaagggcgucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgaccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugcaagaucugcaucuga

SEQ ID NO: 69247 - RNA, 1701 nt, Artificial Sequence
  derived and/or modified sequence opt1 from hemagglutinin__InfluenzaA__AFB77633
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccacggccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucgccauggagcgcaacgccggguccggcaucaucaucagcgacacccccgugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaaggucaagaaccagcugaagaacaacgccaaggagaucgggaacggcugcuucgaguucuaccacaagugcgacaacacgccgaucaagaacgugaagaacgggaccuacgacuaccccaaguacuccgaggaggccaagcugaaccgcgaggagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 69248 - RNA, 1701 nt, Artificial Sequence
  derived and/or modified sequence opt1 from hemagglutinin__InfluenzaA__AFB77634
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggagaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 69249 - RNA, 1701 nt, Artificial Sequence
  derived and/or modified sequence opt1 from hemagglutinin__InfluenzaA__AFB77635
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagccccugguccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucaccaucgggaagugcccgaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 69250 - RNA, 1701 nt, Artificial Sequence
  derived and/or modified sequence opt1 from hemagglutinin__InfluenzaA__AFB77636
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaaggccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugaugguggucagccucggggccaucagcuucuggaugugcuccaacggcagccugcagugccggaucugcaucuga

SEQ ID NO: 69251 - RNA, 1701 nt, Artificial Sequence
  derived and/or modified sequence opt1 from hemagglutinin__InfluenzaA__AFB77637
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagggccgggaccaggaggggcgcaugaacuacuacuggacccuggucgagcccggcgacaagaucaccuucgaggcgacggggaaccucguggugccccgguacgccuucgccauggagcgcaacgccggcagcggcaucaucaucuccgacacccccguccacgacugcaacacgaccugccagaccccgaagggggccaucaacaccagccugcccuuccagaacauccaccccaucaccaucggcaagugccccaaguacgugaaguccaccaagcugcggcucgcgacggggcugcgcaacgugccgagcauccagucccggggccuguucggggccaucgccggcuucaucgagggcggguggaccggcauggucgacgggugguacggcuaccaccaccagaacgagcaggggagcggcuacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcucccugguccucguggugagccugggcgccaucagcuucuggaugugcuccaacggcagccugcagugccggaucugcaucuga

SEQ ID NO: 69252 - RNA, 1701 nt, Artificial Sequence
  derived and/or modified sequence opt1 from hemagglutinin__InfluenzaA__AFB77638
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaaguucuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 69253 - RNA, 1701 nt, Artificial Sequence; identical to SEQ ID NO: 67875
  derived and/or modified sequence opt1 from hemagglutinin__InfluenzaA__AFB77639

SEQ ID NO: 69254 - RNA, 1701 nt, Artificial Sequence
  derived and/or modified sequence opt1 from hemagglutinin__InfluenzaA__AFB77640
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagggccuguaccagaacgccgacgccuacguguucgugggcaccucccgguacagcaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucucccugggcgccaucagcuucuggaugugcagcaacggcucccugcagugccggaucugcaucuga

SEQ ID NO: 69255 - RNA, 1701 nt, Artificial Sequence
  derived and/or modified sequence opt1 from hemagglutinin__InfluenzaA__AFB77641
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacaugugcauggagagcgugaagaacgggacguacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 69256 - RNA, 1701 nt, Artificial Sequence; identical to SEQ ID NO: 67875
  derived and/or modified sequence opt1 from hemagglutinin__InfluenzaA__AFB77642

SEQ ID NO: 69257 - RNA, 1701 nt, Artificial Sequence
  derived and/or modified sequence opt1 from hemagglutinin__InfluenzaA__AFB77643
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagcccagcuccuggccgaaccacgacagcaacaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaccgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacgacaccaaggacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 69258 - RNA, 1701 nt, Artificial Sequence
  derived and/or modified sequence opt1 from hemagglutinin__InfluenzaA__AFB77691
augaagaccaucaucgcccugagcuacauccucugccugguguucgcccagaagcugcccggcaacgacaacuccaccgcgacccucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgagaagcucuacaucuggggcguccaccaccccgggaccgacaaggaccagaucuuccuguacgcgcaggccuccgggcggaucaccgugagcacgaagcgcucccagcaggccgugaucccgaacaucggcagccggcugcgcguccggaacauccccagccgcaucuccaucuacuggaccaucgugaagcccggcgacauccuccugaucaacagcaccgggaaccugaacgcgccccggggcuacuucaagauccgcuccggcaagagcuccaucaugcggagcgacgccccgaucgggaagugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaaccagcuccgcgagaacgcggaggacauggggaacggcugcuucaagaucuaccacaagugcgacaacacgugcaucgggagcauccgcaacggcaccuacgaccacgacgccuaccgggacgaggcccugaacaaccgcuuccagaucaagggggucgagcugaaguccggcuacaaggacuggauccucuggaucagcuucgccaucuccugcuuccugcugugcguggcccuccugggcuucaucaugugggcgugccagaaggggaacauccggugcaacaucugcaucuga

SEQ ID NO: 69259 - RNA, 1701 nt, Artificial Sequence
  derived and/or modified sequence opt1 from hemagglutinin__InfluenzaA__AFB77692
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaccggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggcgugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 69260 - RNA, 1701 nt, Artificial Sequence; identical to SEQ ID NO: 68790
  derived and/or modified sequence opt1 from hemagglutinin__InfluenzaA__AFB77693

SEQ ID NO: 69261 - RNA, 1701 nt, Artificial Sequence
  derived and/or modified sequence opt1 from hemagglutinin__InfluenzaA__AFB77694
augaagaccaucaucgcccugagcuacauccucugccugguguucgcccagaagcugcccggcaacgacaacuccaccgcgacccucugccuggggcaccacgccgucccgaacggcaccaucgugaagaccaucgccaacgaccagaucgaggugaccaacgccacggagcugguccagaacagcuccaccggggagaucugcgacagcccccaccagauccucgacggcgagaacugcacccugaucgacgcccugcucggggacccccagugcgacgacuuccagaacaagaagugggaccuguucguggagcgcuccaaggcguacagcaacugcuaccccuacgacgugccggacuacgccucccugcggagccucgucgccuccagcggcacccuggaguucaacaacgaguccuucaacuggacgggcgugacccagaacgggaccagcuccgccugcauccgccggagcaacaacuccuucuucagccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccggccggaucaccgugagcaccaagcgcucccagcaggccgugaucccgaacaucgggagccggccccgcguccggaacauccccagccgcaucuccaucuacuggacgaucgugaagcccggcgacauccugcucaucaacagcaccggcaaccugaucgccccgcggggguacuucaagauccgcuccggcaagagcuccaucaugcggagcgacgcgcccaucgggaagugcaacuccgagugcaucacccccaacggcagcauccccaacgacaagccguuccagaacgugaaccgcaucaccuacggcgccugcccccgguacgucaagcagaacacgcugaagcucgccaccgggaugcgcaacgugcccgagaagcagacccggggcaucuucggggccaucgccggcuucaucgagaacgggugggagggcaugguggacggcugguacggguuccgccaccagaacuccgagggccgggggcaggcggccgaccucaagagcacccaggccgccaucgaccagaucaacggcaagcugaaccgccugaucgggaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacacgugcaucggcagcauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggcgugccagaagggcaacauccggugcaacaucugcaucuga

SEQ ID NO: 69262 - RNA, 1701 nt, Artificial Sequence
  derived and/or modified sequence opt1 from hemagglutinin__InfluenzaA__AFB77695
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacgacuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggcgugacccagaacgggaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcaggccgugaucccgaacaucgggagccggccccgcguccggaacauccccagccgcaucuccaucuacuggaccaucgugaagcccggcgacauccugcucaucaacagcaccggcaaccugaucgccccgcggggguacuucaagauccgcuccggcaagagcuccaucaugcggagcgacgcccccaucgggaagugcaacuccgagugcaucacccccaacggcagcauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacuccgagggccgggggcaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggcgugccagaagggcaacauccggugcaacaucugcaucuga

SEQ ID NO: 69263 - RNA, 1701 nt, Artificial Sequence
  derived and/or modified sequence opt1 from hemagglutinin__InfluenzaA__AFB78126
augaagaccaucaucgcccugagcuacauccucugccugguguucgcccagaagcugcccggcaacgacaacuccaccgcgacgcucugccuggggcaccacgccgucagcaacggcacccuggugaagaccaucaccaacgaccagaucgaggugacgaacgccaccgagcucguccaguccagcuccaccgggcgcaucugcgacagcccgcaccagauccuggacggcgagaacugcacccugaucgacgcccuccugggggacccccacugcgacggcuuccagaacaaggagugggaccuguucguggagcgguccaaggccuacagcaacugcuaccccuacgacgugcccgacuacgcgucccuccgcagccuggucgccuccagcggcacgcuggaguucaacaacgaguccuucaacuggaccgggguggcccaggacggcaccagcuccgccugcaagcggcgcagcaacaaguccuucuucagccggcucaacuggcugcaccagcugaaguacaaguacccggcgcucaacgugaccaugcccaacaacgagaaguucgacaagcuguacaucuggggcguccaccaccccuccacggacagcgaccagaucagcaucuacgcccaggccuccgggcgcgugaccgugagcaccaagcggucccagcagaccgucauccccaacaucgggagcuccccgugggugcgcggcgccagcucccggaucagcaucuacuggacgaucgugaagcccggcgacauccugcucaucaacuccaccgggaaccugaucgcgccccgcggcuacuucaagauccggagcgggaaguccagcaucaugcgcuccgacgcccccaucggcaagugcaacagcgagugcaucaccccgaacggcuccauccccaacgacaagcccuuccagaacgucaaccggaucaccuacggggccugcccccgcuacgugaagcagaacacgcugaagcucgccaccggcaugcggaacgugccggagaagcagacccgcgggaucuucggcgccaucgccggguucaucgagaacggcugggagggcauggucgacgggugguacggcuuccggcaccagaacagcgaggggaccggccaggcggccgaccugaaguccacgcaggccgccaccaaccagaucaacgggaagcugaaccgccucaucgagaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgccugcaucggcagcauccgcaacgggaccuacgaccacgacguguaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 69264 - RNA, 1701 nt, Artificial Sequence
  derived and/or modified sequence opt1 from hemagglutinin__InfluenzaA__AFC34056
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagcgcacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacaaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69265 - RNA, 1701 nt, Artificial Sequence; identical to SEQ ID NO: 69264
  derived and/or modified sequence opt1 from hemagglutinin__InfluenzaA__AFC34057

SEQ ID NO: 69266 - RNA, 1701 nt, Artificial Sequence
  derived and/or modified sequence opt1 from hemagglutinin__InfluenzaA__AFD32426
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugcaagcugcgcggcguggcgccccuccaccuggggaagugcaacaucgccggccggauccuggggaacccggagugcgagagccucuccacggccagcuccuggagcuacaucgucgagacccccuccagcgacaacgggaccugcuaccccggcgacuucaucgacuacgaggagcugcgcgagcagcuguccagcguguccagcuucgagcgguucgagaucuuccccaagaccuccagcuggccgaaccacgacuccaacaagggggugacggccgcgugcccccacgccggcgccaagagcuucuacaagaaccucaucuggcuggucaagaaggggaacuccuaccccaagcugagcaagagcuacaucaacgacaagggcaaggaggugcucgugcugugggggauccaccaccccuccaccagcgccgaccagcagucccuguaccagaacgccgacaccuacgucuucgugggcagcucccgcuacagcaagaaguucaagccggagaucgcgauccggcccaaggugcgcgaccaggagggccggaugaacuacuacuggacccucgucgagcccggggacaagaucacguucgaggccaccggcaaccugguggugccccgcuacgccuucgccauggagcggaacgccggguccggcaucaucaucagcgacaccccgguccacgacugcaacaccaagugccagacgccccugggcgcgaucaacuccagccuccccuaccagaacauccaccccgugaccaucggggagugcccgaaguacgugcgcuccgccaagcugcggauggucaccggccugcgcaacacccccagcauccagucccggggccucuucggcgccaucgccggguucaucgagggcggcuggacggggaugaucgacggcugguacggguaccaccaccagaacgagcagggcagcggguacgccgcggaccagaaguccacccagaacgccaucaacggcaucaccaacaaggugaacaccgugaucgagaagaugaacauccaguucacggccgucggcaaggaguucaacaagcuggagaagcgcauggagaaccugaacaagaagguggacgacggguuccucgacaucuggaccuacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcgacaacgagugcauggagagcguccgcaacggcaccuacgacuaccccaaguacuccgaggagagcaagcugaaccgggagaagguggacggggugaagcucgagagcaugggcaucuaccagauccuggcgaucuacuccacggucgccagcucccuggugcuccuggugagccugggcgccaucuccuucuggaugugcagcaacgggucccuccagugccgcaucugcaucuga

SEQ ID NO: 69267 - RNA, 1698 nt, Artificial Sequence
  derived and/or modified sequence opt1 from hemagglutinin__InfluenzaA__AFD32427
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugcgaccuggacggcgugaagccccucauccugcgcgacugcagcgucgcgggguggcugcucggcaacccgaugugcgacgaguucaucaacgugcccgagugguccuacaucguggagaaggccaaccccgucaacgaccugugcuaccccggggacuucaacgacuacgaggagcugaagcaccuccugagccggaucaaccacuucgagaagauccagaucaucccgaaguccagcugguccagccacgaggccucccugggcgugagcuccgccugccccuaccagggcaagagcuccuucuuccgcaacguggucuggcucaucaagaagaacagcacguaccccaccaucaagcgguccuacaacaacaccaaccaggaggaccugcuggugcucugggggauccaccaccccaacgacgcggccgagcagaccaagcuguaccagaacccgacgaccuacaucagcgugggcaccuccacccugaaccagcgccucgucccccggaucgccacgcgcagcaaggugaacgggcagagcggccggauggaguucuucuggaccauccugaagcccaacgacgccaucaacuucgaguccaacgggaacuucaucgcccccgaguacgcguacaagaucgugaagaagggcgacagcaccaucaugaaguccgagcuggaguacggcaacugcaacaccaagugccagacgccgcucggggccaucaacagcucccugcccuaccagaacauccaccccgucaccaucggcgagugccccaaguacgugcgcagcgccaagcugcggauggugaccgggcuccgcaacaccccguccauccagagccggggccuguucggcgccaucgccggguucaucgagggcggguggacgggcaugaucgacgggugguacggcuaccaccaccagaacgagcagggcuccggguacgcggccgaccagaaguccacccagaacgccaucaacggcaucaccaacaaggucaacaccgugaucgagaagaugaacauccaguucacggccguggggaaggaguucaacaagcuggagaagcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggucaagagccagcugaagaacaacgcgaaggagaucgggaacggcugcuucgaguucuaccacaagugcgacaacgagugcauggaguccgugcgcaacggcaccuacgacuaccccaaguacagcgaggaguccaagcucaaccgggagaagguggacggggugaagcuggagagcaugggcaucuaccagauccuggccaucuacuccacgguggccagcucccucguccugcuggugagccucggggccaucagcuucuggaugugcuccaacggcagccugcagugccgcaucugcaucuga

SEQ ID NO: 69268 - RNA, 1722 nt, Artificial Sequence
  derived and/or modified sequence opt1 from hemagglutinin__InfluenzaA__AFD32428
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgaccucgacggcgugaagccccugauccugcgcgacugcuccguggccggguggcuccugggcaaccccaugugcgacgaguucaucaacguccccgaguggagcuacaucguggagaaggccaacccggugaacgaccugugcuaccccggcgacuucaacgacuacgaggagcucaagcaccuccugucccggaucaaccacuucgagaagauccagaucauccccaagagcuccuggagcucccacgaggcgagccucggggucuccagcgccugccccuaccagggcaaguccagcuucuuccgcaacgugguguggcugaucaagaagaacuccaccuacccgacgaucaagcggagcuacaacaacaccaaccaggaggaccugcucguccugugggggauccaccaccccaacgacgccgccgagcagaccaagcuguaccagaaccccaccacguacaucuccgugggcaccagcacccucaaccagcgccuggugccccggaucgcgacccgcagcaaggucaacgggcaguccggccggauggaguucuucuggacgauccugaagccgaacgacgccaucaacuucgagagcaacggcaacuucaucgcccccgaguacgccuacaagaucgugaagaagggggacuccaccaucaugaaguccgagcucgaguacggcaacugcaacagcgagugcaucacccccaacgggagcauccccaacgacaagccguuccagaacgugaaccgcaucaccuacggcgccugcccccgguacgucaagcagaacacgcugaagcuggcgaccggcaugcgcaacgugcccgagaagcagacccgggggaucuucggcgccaucgccggguucaucgagaacggcugggaggggaugguggacggcugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugaccgacuccgagaugaacaagcuguucgagaagacgaagaagcagcugcgcgagaacgccgaggacaugggcaacggcugcuucaagaucuaccacaagugcgacaacgcgugcaucgggagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgcccugcugggguucaucaugugggccugccagaagggcaacauccgcugcaacaucugcaucuga

SEQ ID NO: 69269 - RNA, 1704 nt, Artificial Sequence
  derived and/or modified sequence opt1 from hemagglutinin__InfluenzaA__AFD32429
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcacccagggcaagcgccccacggaccucgggcagugcggccugcugggcacccucaucgggccgccccagugcgaccaguuccuggaguucgacgccgaccugaucaucgagcggcgcgagggcaccgacgugugcuaccccgggaaguucaccaacgaggagucccuccggcagauccugcgcggcagcgggggcaucgacaaggaguccaugggcuucacguacagcgggauccggaccaacggcgccaccuccgcgugccgccggagcggguccagcuucuacgccgagaugaaguggcugcucuccaacagcgacaacgccgaguucccccagaugaccaaguccuaccgcaacccccggaacaagcccgcccugaucaucuggggcgugcaccacagcggcuccgcgacggagcagaccaagcuguacgggagcggcaacaagcucaucaccgucggguccagcaaguaccagcagagcuucaccccgucccccggcgcccgcccccaggugaacgggcagagcggccggaucgacuuccacuggcugcugcucgaccccaacgacacggugaccuucaccuucaacggcgccuucaucgccccggaccgcgccuccuucuuccgcggggagagccugggcguccaguccgacgugccccuggacagcgggugcaacuccgagugcaucacccccaacggcagcauccccaacgacaagccguuccagaacgugaaccggaucacguacggggcgugcccccgguacgucaagcagaacacccucaagcuggccaccggcaugcgcaacgugcccgagaagcagacccggggcaucuucggggccaucgccggcuucaucgagaacgggugggagggcaugguggacgggugguacggcuuccgccaccagaacuccgagggccgggggcaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcugaaguccggguacaaggacuggauccucuggaucagcuucgccaucuccugcuuccugcugugcguggcccuccugggcuucaucaugugggcgugccagaagggcaacauccggugcaacaucugcaucuga

SEQ ID NO: 69270 - RNA, 1701 nt, Artificial Sequence; identical to SEQ ID NO: 61081
  derived and/or modified sequence opt1 from hemagglutinin__InfluenzaA__AFD63527

SEQ ID NO: 69271 - RNA, 1701 nt, Artificial Sequence
  derived and/or modified sequence opt1 from hemagglutinin__InfluenzaA__AFD63538
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcgguccaucgucgccagcuccgggacgcucgaguucaacaacgagagcuucaacuggaccggcgugacccagaacgggaccuccagcgccugcaagcgcaaguccaacaagagcuucuucucccggcugaacuggcugacgcaccucaaguacaaguaccccgcccugaacgugaccaugcccaacaacgagaaguucgacaagcuguacaucuggggcguccaccaccccgggaccgacaacgaccagaucagccucuacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccugcugaucaacuccaccggcaaccucaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcuggccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccucaaguccacccaggcggccaucaaccagaucaacggcaagcugaaccgccugaucggcaagaccaacgagaaguuccaccagaucgagaaggaguucagcgagguggaggggcggauccaggaccucgagaaguacguggaggacacgaagaucgaccugugguccuacaacgccgagcugcucgucgcccuggagaaccagcacaccaucgaccugaccgacagcgagaugaacaagcuguucgagcgcaccaagaagcagcuccgggagaacgccgaggacaugggcaacgggugcuucaagaucuaccacaagugcgacaacgcgugcaucggcuccauccgcaacgggacguacgaccacgacguguaccgcgacgaggcccugaacaaccgguaccagaucaagggcguggagcucaagagcggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 69272 - RNA, 1701 nt, Artificial Sequence
  derived and/or modified sequence opt1 from hemagglutinin__InfluenzaA__AFD63549
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcagccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69273 - RNA, 1701 nt, Artificial Sequence; identical to SEQ ID NO: 61081
  derived and/or modified sequence opt1 from hemagglutinin__InfluenzaA__AFD63571

SEQ ID NO: 69274 - RNA, 1701 nt, Artificial Sequence
  derived and/or modified sequence opt1 from hemagglutinin__InfluenzaA__AFD63615
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggagcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacauggggaacggcugcuucaagaucuaccacaagugcgacaacgcgugcaucggguccauccgcaacggcacguacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 69275 - RNA, 1701 nt, Artificial Sequence
  derived and/or modified sequence opt1 from hemagglutinin__InfluenzaA__AFD63626
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacaucagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 69276 - RNA, 1701 nt, Artificial Sequence
  derived and/or modified sequence opt1 from hemagglutinin__InfluenzaA__AFD63637
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccacgugcaagcgccggagcaacaaguccuucuucagccgccugaacuggcucacccaccugaaguacaaguaccccgcccugaacgugaccaugcccaacaacgagaaguucgacaagcucuacaucuggggcguccaccaccccgggaccgacuccgaccagaucagccuguacgcccaggcguccggccggaucacggugagcaccaagcgcagccagcagaccgugaucccgaacaucggcucccggccccgcguccgggacgugagcucccgcaucagcaucuacuggaccaucgugaagcccggggacauccugcucaucaacuccacgggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcugaaccggcucaucggcaagacgaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgccugcaucggcuccauccgcaacgggaccuacgaccacgacguguaccgggacgaggcgcucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 69277 - RNA, 1701 nt, Artificial Sequence
  derived and/or modified sequence opt1 from hemagglutinin__InfluenzaA__AFD63648
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacccuggaguucaacaacgaguccuucgacuggacgggcgugacccagaacgggaccagcuccgccugcaagcgccggagcaacaaguccuucuucagccgccugaacuggcucacccaccugaaguacaaguaccccgcccugaacgugacgaugcccaacaacgagaaguucgacaagcucuacaucuggggcguccaccaccccgggaccgacuccgaccagaucagccuguacgcgcaggccuccggccggaucaccgugagcaccaagcgcagccagcagacggugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgucaaccgcaucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 69278 - RNA, 1701 nt, Artificial Sequence; identical to SEQ ID NO: 61081
  derived and/or modified sequence opt1 from hemagglutinin__InfluenzaA__AFD63659

SEQ ID NO: 69279 - RNA, 1701 nt, Artificial Sequence
  derived and/or modified sequence opt1 from hemagglutinin__InfluenzaA__AFD63681
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccugcucaucaacuccaccggcaaccugaucgcgccccgcggguacuucaagguccggagcggcaaguccagcaucaugcgcuccgacgccccgaucggcaagugcaacagcgagugcaucacgcccaacggguccauccccaacgacaagcccuuccagaacgugaaccggaucaccuacggcgccugcccgcgcuacgugaagcagaacacccugaagcucgccaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69280 - RNA, 1701 nt, Artificial Sequence
  derived and/or modified sequence opt1 from hemagglutinin__InfluenzaA__AFD63692
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccugcaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccucaagcuggccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcucaaccggcugaucggcaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcugaaguccggcuacaaggacuggauccucuggaucagcuucgccaucagcugcuuccugcugugcgucgcccuccugggguucaucaugugggccugccagaagggcaacauccggugcaacaucugcaucuga

SEQ ID NO: 69281 - RNA, 1701 nt, Artificial Sequence
  derived and/or modified sequence opt1 from hemagglutinin__InfluenzaA__AFD63703
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccagcgggaucugcgacucccccuaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucgacuggaccggggugacccagaacggcaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcgggcggaucaccgugagcacgaagcgcucccagcagaccgugaucccgaacaucggcagccggccccgcguccgggacguguccagccagaucuccaucuacuggaccaucgugaagcccggcgacauccugcucaucaacagcaccgggaaccugaucgcgccccgcggcuacuucaagauccgguccggcaagagcuccaucaugcgcagcgacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacuccgaggggaccggccaggccgccgaccucaagagcacccaggcggccaucaaccagaucaacgggaagcugaaccgccugaucggcaagaccaacgagaaguuccaccagaucgagaaggaguucuccgagguggagggccggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcacguacgaccacgacguguaccgcgacgaggcccucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 69282 - RNA, 1701 nt, Artificial Sequence
  derived and/or modified sequence opt1 from hemagglutinin__InfluenzaA__AFD63714
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccacgugcaagcgccggagcaacaaguccuucuucagccgccugaacuggcucacccaccugaaguacaaguaccccgcccugaacgugaccaugcccaacaacgagaaguucgacaagcucuacaucuggggcguccaccaccccgggaccgacaacgaccagaucucccuguacgcccaggcgagcggccggaucacgguguccaccaagcgcagccagcagaccgugaucccgaacaucggcagccggccccgcguccgggacguguccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccucaagagcacccaggccgcgaucaaccagaucaacggcaagcugaaccggcugaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcagaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccacaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69283 - RNA, 1701 nt, Artificial Sequence
  derived and/or modified sequence opt1 from hemagglutinin__InfluenzaA__AFD63736
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccacgugcaagcgccggagcaacaaguccuucuucagccgccugaacuggcucacccaccugaaguacaaguaccccgcccugaacgugaccaugcccaacaacgagaaguucgacaagcucuacaucuggggcguccaccaccccgggaccgacaacgaccagaucucccuguacgcccaggcgagcggccggaucacgguguccaccaagcgcagccagcagaccgugaucccgaacaucggcagccggccccgcguccgggacguguccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccucaagagcacccaggccgcgaucaaccagaucaacggcaagcugaaccggcugaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccacaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69284 - RNA, 1701 nt, Artificial Sequence
  derived and/or modified sequence opt1 from hemagglutinin__InfluenzaA__AFD63747
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccgcaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 69285 - RNA, 1701 nt, Artificial Sequence
  derived and/or modified sequence opt1 from hemagglutinin__InfluenzaA__AFD63758
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 69286 - RNA, 1701 nt, Artificial Sequence
  derived and/or modified sequence opt1 from hemagglutinin__InfluenzaA__AFD63769
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcagccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccacaucaaguccguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 69287 - RNA, 1701 nt, Artificial Sequence; identical to SEQ ID NO: 61081
  derived and/or modified sequence opt1 from hemagglutinin__InfluenzaA__AFD63780

SEQ ID NO: 69288 - RNA, 1701 nt, Artificial Sequence; identical to SEQ ID NO: 69285
  derived and/or modified sequence opt1 from hemagglutinin__InfluenzaA__AFD63791

SEQ ID NO: 69289 - RNA, 1701 nt, Artificial Sequence; identical to SEQ ID NO: 61081
  derived and/or modified sequence opt1 from hemagglutinin__InfluenzaA__AFD63802

SEQ ID NO: 69290 - RNA, 1701 nt, Artificial Sequence
  derived and/or modified sequence opt1 from hemagglutinin__InfluenzaA__AFD63813
augaagaccaucaucgcccugagcuacauccucucccugguguucgcccagaaguuccccggcaacgacaacagcaccgcgacgcugugccucgggcaccacgccgucccgaacggcaccaucgugaagaccaucaccaacgaccagaucgaggugacgaacgccaccgagcugguccagaucuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggagccucgaguucaacaacgaguccuucgacuggacgggcgugacccagaacgggaccagcuccgccugcaagcgccggagcaacaaguccuucuucagccgccugaacuggcugacccaccucaaguacaaguaccccgcccugaacgugacgaugcccaacaacgagaaguucgacaagcuguacaucuggggcguccaccaccccgggaccgacuccgaccagaucagccucuacgcgcaggccagcggccggaucaccguguccaccaagcgcagccagcagacggugaucccgaacaucggcucccggccccgcguccgggacaucagcucccgcaucagcaucuacuggaccaucgugaagcccggggacauccugcugaucaacuccaccggcaaccucaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucacguacggcgccugcccgcgguacgucaagcagaacacccugaagcuggccaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccucaaguccacccaggcggccaucaaccagaucaacggcaagcugaaccggcugaucggcaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucagcuucgccacguccugcuuccugcucugcguggcccugcugggguucaucaugugggccugccagaagggcaacauccggugcaacaucugcaucuga

SEQ ID NO: 69291 - RNA, 1701 nt, Artificial Sequence; identical to SEQ ID NO: 69275
  derived and/or modified sequence opt1 from hemagglutinin__InfluenzaA__AFD63824

SEQ ID NO: 69292 - RNA, 1701 nt, Artificial Sequence; identical to SEQ ID NO: 61081
  derived and/or modified sequence opt1 from hemagglutinin__InfluenzaA__AFD63846

SEQ ID NO: 69293 - RNA, 1701 nt, Artificial Sequence; identical to SEQ ID NO: 62319
  derived and/or modified sequence opt1 from hemagglutinin__InfluenzaA__AFD63857

SEQ ID NO: 69294 - RNA, 1701 nt, Artificial Sequence; identical to SEQ ID NO: 61081
  derived and/or modified sequence opt1 from hemagglutinin__InfluenzaA__AFD63868

SEQ ID NO: 69295 - RNA, 1701 nt, Artificial Sequence; identical to SEQ ID NO: 61081
  derived and/or modified sequence opt1 from hemagglutinin__InfluenzaA__AFD63890

SEQ ID NO: 69296 - RNA, 1701 nt, Artificial Sequence; identical to SEQ ID NO: 61081
  derived and/or modified sequence opt1 from hemagglutinin__InfluenzaA__AFD63901

SEQ ID NO: 69297 - RNA, 1701 nt, Artificial Sequence; identical to SEQ ID NO: 61081
  derived and/or modified sequence opt1 from hemagglutinin__InfluenzaA__AFD63912

SEQ ID NO: 69298 - RNA, 1701 nt, Artificial Sequence
  derived and/or modified sequence opt1 from hemagglutinin__InfluenzaA__AFD63923
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacaucagcucccggaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgugaaccggaucaccuacggcgccugcccgcgcuacgucaagcagaacacccugaagcucgccaccgggaugcggaacgugcccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69299 - RNA, 1701 nt, Artificial Sequence
  derived and/or modified sequence opt1 from hemagglutinin__InfluenzaA__AFD63934
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgagagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccguggucaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 69300 - RNA, 1701 nt, Artificial Sequence; identical to SEQ ID NO: 69275
  derived and/or modified sequence opt1 from hemagglutinin__InfluenzaA__AFD63945

SEQ ID NO: 69301 - RNA, 1701 nt, Artificial Sequence; identical to SEQ ID NO: 69275
  derived and/or modified sequence opt1 from hemagglutinin__InfluenzaA__AFD63956

SEQ ID NO: 69302 - RNA, 1701 nt, Artificial Sequence; identical to SEQ ID NO: 69275
  derived and/or modified sequence opt1 from hemagglutinin__InfluenzaA__AFD63967

SEQ ID NO: 69303 - RNA, 1701 nt, Artificial Sequence; identical to SEQ ID NO: 61081
  derived and/or modified sequence opt1 from hemagglutinin__InfluenzaA__AFD63989

SEQ ID NO: 69304 - RNA, 1701 nt, Artificial Sequence; identical to SEQ ID NO: 61081
  derived and/or modified sequence opt1 from hemagglutinin__InfluenzaA__AFD64000

SEQ ID NO: 69305 - RNA, 1701 nt, Artificial Sequence
  derived and/or modified sequence opt1 from hemagglutinin__InfluenzaA__AFD64011
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccccgggcaagaucaccgugagcacgaagcggagccagcagaccgugauccccaacaucggcucccgcccccggguccgcgacgugagcucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcgacaucugcaucuga

SEQ ID NO: 69306 - RNA, 1701 nt, Artificial Sequence; identical to SEQ ID NO: 61081
  derived and/or modified sequence opt1 from hemagglutinin__InfluenzaA__AFD64022

SEQ ID NO: 69307 - RNA, 1701 nt, Artificial Sequence; identical to SEQ ID NO: 61081
  derived and/or modified sequence opt1 from hemagglutinin__InfluenzaA__AFD64033

SEQ ID NO: 69308 - RNA, 1701 nt, Artificial Sequence
  derived and/or modified sequence opt1 from hemagglutinin__InfluenzaA__AFD64044
augaagaccaucaucgcccugagcuacauccucugccugguguucgcccagaagcugcccggcaacgagaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 69309 - RNA, 1701 nt, Artificial Sequence; identical to SEQ ID NO: 69285
  derived and/or modified sequence opt1 from hemagglutinin__InfluenzaA__AFD64055

SEQ ID NO: 69310 - RNA, 1701 nt, Artificial Sequence
  derived and/or modified sequence opt1 from hemagglutinin__InfluenzaA__AFD64066
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacacgagccugcggucccucgucgcgagcuccgggacccuggaguucaacaacgagagcuucaacuggaccggcgugacccagaacgggacguccagcgccugcaagcgccgguccaacaagagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcccaggcguccggccggaucacggugagcaccaagcgcagccagcagaccgugaucccgaacaucggcucccggccccgcguccgggacgugcccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacggcugggaggggauggucgacggcugguacggguuccgccaccagaacgccgagggcaccgggcaggccgccgaccugaaguccacccaggcggccaucaaccagaucaacggcaagcugaaccggcucaucggcaagacgaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaagaacuggauccuguggaucuccuucgccaucagcugcuuccuccugugcgucgcccugcucggguucaucaugugggccugccagaagggcaacauccggugcaacaucugcaucuga

SEQ ID NO: 69311 - RNA, 1701 nt, Artificial Sequence
  derived and/or modified sequence opt1 from hemagglutinin__InfluenzaA__AFD64077
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcauccgggacgucagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 69312 - RNA, 1701 nt, Artificial Sequence; identical to SEQ ID NO: 61081
  derived and/or modified sequence opt1 from hemagglutinin__InfluenzaA__AFD64088

SEQ ID NO: 69313 - RNA, 1701 nt, Artificial Sequence; identical to SEQ ID NO: 61081
  derived and/or modified sequence opt1 from hemagglutinin__InfluenzaA__AFD64099

SEQ ID NO: 69314 - RNA, 1701 nt, Artificial Sequence; identical to SEQ ID NO: 69285
  derived and/or modified sequence opt1 from hemagglutinin__InfluenzaA__AFD64110

SEQ ID NO: 69315 - RNA, 1701 nt, Artificial Sequence
  derived and/or modified sequence opt1 from hemagglutinin__InfluenzaA__AFD64121
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagccgggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggaaguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 69316 - RNA, 1701 nt, Artificial Sequence; identical to SEQ ID NO: 61081
  derived and/or modified sequence opt1 from hemagglutinin__InfluenzaA__AFD64132

SEQ ID NO: 69317 - RNA, 1701 nt, Artificial Sequence; identical to SEQ ID NO: 69275
  derived and/or modified sequence opt1 from hemagglutinin__InfluenzaA__AFD64143

SEQ ID NO: 69318 - RNA, 1701 nt, Artificial Sequence; identical to SEQ ID NO: 61081
  derived and/or modified sequence opt1 from hemagglutinin__InfluenzaA__AFD64154

SEQ ID NO: 69319 - RNA, 1701 nt, Artificial Sequence
  derived and/or modified sequence opt1 from hemagglutinin__InfluenzaA__AFD64179
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccagaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcucaagagcggcuacaaggacuggauccuguggaucuccuucgccaucagcugcuuccugcugugcgucgcccugcucggguucaucaugugggccugccagaagggcaacauccgcugcaacaucugcaucuga

SEQ ID NO: 69320 - RNA, 1701 nt, Artificial Sequence; identical to SEQ ID NO: 69319
  derived and/or modified sequence opt1 from hemagglutinin__InfluenzaA__AFD64190

SEQ ID NO: 69321 - RNA, 1701 nt, Artificial Sequence; identical to SEQ ID NO: 69275
  derived and/or modified sequence opt1 from hemagglutinin__InfluenzaA__AFD64201

SEQ ID NO: 69322 - RNA, 1701 nt, Artificial Sequence; identical to SEQ ID NO: 69285
  derived and/or modified sequence opt1 from hemagglutinin__InfluenzaA__AFD64212

SEQ ID NO: 69323 - RNA, 1701 nt, Artificial Sequence
  derived and/or modified sequence opt1 from hemagglutinin__InfluenzaA__AFD64223
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccugcaccccgggaccgacagcgaccagauccggcuguacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccuccugaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacaucaagcagaacacccucaagcuggccaccgggaugcggaacgugcccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcucaaccgccugaucggcaagaccaacgagaaguuccaccagaucgagaaggaguucagcgaggucgaggggcggauccaggaccuggagaaguacguggaggacacgaagaucgaccucugguccuacaacgccgagcugcugguggcccucgagaaccaguacaccaucgaccugaccgacagcgagaugaacaagcuguucgagcgcaccaagaagcagcuccgcgagaacgccgaggacaugggcaacgggugcuucaagaucuaccacaagugcgacaacgcgugcaucggcuccauccggaacgggacguacgaccacgacgucuaccgcgacgaggcccugaacaaccgguuccagaucaagggcguggagcugaaguccggcuacaaggacuggauccucuggaucuccuucgccaucagcugcuuccugcugugcguggcccuccugggguucaucaugugggccugccagaagggcaacauccgcugcaacaucugcaucuga

SEQ ID NO: 69324 - RNA, 1701 nt, Artificial Sequence
  derived and/or modified sequence opt1 from hemagglutinin__InfluenzaA__AFD64315
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaaccagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 69325 - RNA, 1701 nt, Artificial Sequence; identical to SEQ ID NO: 69315
  derived and/or modified sequence opt1 from hemagglutinin__InfluenzaA__AFD64326

SEQ ID NO: 69326 - RNA, 1701 nt, Artificial Sequence; identical to SEQ ID NO: 69285
  derived and/or modified sequence opt1 from hemagglutinin__InfluenzaA__AFD64337

SEQ ID NO: 69327 - RNA, 1701 nt, Artificial Sequence; identical to SEQ ID NO: 61081
  derived and/or modified sequence opt1 from hemagglutinin__InfluenzaA__AFD64348

SEQ ID NO: 69328 - RNA, 1701 nt, Artificial Sequence; identical to SEQ ID NO: 69285
  derived and/or modified sequence opt1 from hemagglutinin__InfluenzaA__AFD64359

SEQ ID NO: 69329 - RNA, 1701 nt, Artificial Sequence
  derived and/or modified sequence opt1 from hemagglutinin__InfluenzaA__AFD64370
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccacugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacaucagcucccggaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgugaaccggaucaccuacggcgccugcccgcgcuacgucaagcagaacacccugaagcucgccaccgggaugcggaacgugcccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69330 - RNA, 1701 nt, Artificial Sequence; identical to SEQ ID NO: 61081
  derived and/or modified sequence opt1 from hemagglutinin__InfluenzaA__AFD64381

SEQ ID NO: 69331 - RNA, 1701 nt, Artificial Sequence; identical to SEQ ID NO: 69285
  derived and/or modified sequence opt1 from hemagglutinin__InfluenzaA__AFD64392

SEQ ID NO: 69332 - RNA, 1701 nt, Artificial Sequence; identical to SEQ ID NO: 69275
  derived and/or modified sequence opt1 from hemagglutinin__InfluenzaA__AFD64403

SEQ ID NO: 69333 - RNA, 1701 nt, Artificial Sequence; identical to SEQ ID NO: 69275
  derived and/or modified sequence opt1 from hemagglutinin__InfluenzaA__AFD64414

SEQ ID NO: 69334 - RNA, 1701 nt, Artificial Sequence
  derived and/or modified sequence opt1 from hemagglutinin__InfluenzaA__AFD64425
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccgaacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacaacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 69335 - RNA, 1701 nt, Artificial Sequence; identical to SEQ ID NO: 61081
  derived and/or modified sequence opt1 from hemagglutinin__InfluenzaA__AFD64436

SEQ ID NO: 69336 - RNA, 1701 nt, Artificial Sequence; identical to SEQ ID NO: 61081
  derived and/or modified sequence opt1 from hemagglutinin__InfluenzaA__AFD64447

SEQ ID NO: 69337 - RNA, 1701 nt, Artificial Sequence
  derived and/or modified sequence opt1 from hemagglutinin__InfluenzaA__AFD64458
augaagaccaucaucgcccugagcuacauccucugccugguguucgcccagaagcugcccggcaacgacaacuccaccgcgacgcucugccuggggcaccacgccguccagaacggcaccaucgugaagaccaucaccaacgaccagaucgaggugacgaacgccaccgagcugguccagagcuccagcaccgggggcaucugcgacuccccgcaccagauccucgacggggagaacugcacccugaucgacgcccugcucggcgacccccagugcgacggcuuccagaacaagaagugggaccuguucguggagcgcagcaaggccuacuccaacugcuaccccuacgacgugcccgacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguacccggcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugauccccaacaucggcagccggccgcgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgcccccaucggcaagugcaacuccgagugcaucacgccgaacgggagcauccccaacgacaagcccuuccagaacgucaaccgcaucaccuacggcgccugcccccgguacgugaagcagaacacccugaagcucgccaccgggaugcgcaacgugccggagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 69338 - RNA, 1701 nt, Artificial Sequence; identical to SEQ ID NO: 67863
  derived and/or modified sequence opt1 from hemagglutinin__InfluenzaA__AFD64795

SEQ ID NO: 69339 - RNA, 1701 nt, Artificial Sequence; identical to SEQ ID NO: 67990
  derived and/or modified sequence opt1 from hemagglutinin__InfluenzaA__AFD64799

SEQ ID NO: 69340 - RNA, 1701 nt, Artificial Sequence
  derived and/or modified sequence opt1 from hemagglutinin__InfluenzaA__AFD64802
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccgaguacaaggacuggauccuguggaucuccuucgccaucagcugcuuccuccugugcgucgcgcugcucggcuucaucaugugggccugccagaagggcaacauccggugcaacaucugcaucuga

SEQ ID NO: 69341 - RNA, 1701 nt, Artificial Sequence
  derived and/or modified sequence opt1 from hemagglutinin__InfluenzaA__AFD64804
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 69342 - RNA, 1701 nt, Artificial Sequence
  derived and/or modified sequence opt1 from hemagglutinin__InfluenzaA__AFD64806
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69343 - RNA, 1701 nt, Artificial Sequence
  derived and/or modified sequence opt1 from hemagglutinin__InfluenzaA__AFD64807
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccgggacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcgccccugggcaagugccacagcgccugcaucacgcccaacggcuccauccccaacgacaagccguuccagaacgucaaccgcaucaccuacggggccugcccccgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacauguaccgggacgaggcccugaacaaccgcuuccagaucaaggggguggagcugaaguccggcuacaaggacuggauccucuggaucuccuucgccaucagcugcuuccugcugugcguggcgcuccugggcuucaucaugugggccugccagaaggggaacauccggugcaacaucugcaucuga

SEQ ID NO: 69344 - RNA, 1701 nt, Artificial Sequence
  derived and/or modified sequence opt1 from hemagglutinin__InfluenzaA__AFD64810
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69345 - RNA, 1701 nt, Artificial Sequence
  derived and/or modified sequence opt1 from hemagglutinin__InfluenzaA__AFD64812
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaccgaccagaucaacgggaagcugaaccgccucaucggcaagaccaacgagaaguuccaccagaucgagaaggaguucagcgagguggagggccggauccaggaccuggagaaguacguggaggacacgaagaucgaccugugguccuacaacgccgagcuccuggucgcgcuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcacguacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69346 - RNA, 1701 nt, Artificial Sequence
  derived and/or modified sequence opt1 from hemagglutinin__InfluenzaA__AFD64814
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69347 - RNA, 1701 nt, Artificial Sequence
  derived and/or modified sequence opt1 from hemagglutinin__InfluenzaA__AFD64816
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcaacagcccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggcgugacccagaacgggaccuccagcgccugcaugcgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcaggccgugaucccgaacaucgggagccggccccgcguccggaacauccccucccgcgugagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgcgugcaucacccccaacggcuccauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgccggcuucaucgagaacgggugggagggcauggucgacggcugguacggguuccgccaccagaacagcgagggccgggggcaggcggccgaccugaaguccacgcaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgcgcugcucggcuucaucaugugggccugccagaagggcaacauccggugcaacaucugcaucuga

SEQ ID NO: 69348 - RNA, 1701 nt, Artificial Sequence
  derived and/or modified sequence opt1 from hemagglutinin__InfluenzaA__AFD64818
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcgccccugggcaagugcaucagcgccugcaucacgcccaacggcuccauccccaacgacaagccguuccagaacgucaaccgcaucaccuacggggccugcccccgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 69349 - RNA, 1701 nt, Artificial Sequence
  derived and/or modified sequence opt1 from hemagglutinin__InfluenzaA__AFD64819
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcauccggaacauccccucccgcgucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaucagcgcgugcaucacgcccaacggcuccauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 69350 - RNA, 1701 nt, Artificial Sequence; identical to SEQ ID NO: 67990
  derived and/or modified sequence opt1 from hemagglutinin__InfluenzaA__AFD64820

SEQ ID NO: 69351 - RNA, 1701 nt, Artificial Sequence
  derived and/or modified sequence opt1 from hemagglutinin__InfluenzaA__AFD64822
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcaugcgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69352 - RNA, 1701 nt, Artificial Sequence
  derived and/or modified sequence opt1 from hemagglutinin__InfluenzaA__AFD64823
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggccgcugcaacuccgccugcaucacccccaacggcagcauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacuccgaggggcgcggccaggccgccgaccucaagagcacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaaggggguggagcugaaguccggcuacaaggacuggauccuguggaucagcuucgcgaucuccugcuuccuccugugcgucgcccugcucggcuucaucaugugggccugccagaaggggaacauccgcugcaacaucugcaucuga

SEQ ID NO: 69353 - RNA, 1701 nt, Artificial Sequence
  derived and/or modified sequence opt1 from hemagglutinin__InfluenzaA__AFD64824
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccacgagcugcuuccuccugugcgucgcgcugcucggcuucaucaugugggccugccagaaggggaacauccggugcaacaucugcaucuga

SEQ ID NO: 69354 - RNA, 1701 nt, Artificial Sequence; identical to SEQ ID NO: 69342
  derived and/or modified sequence opt1 from hemagglutinin__InfluenzaA__AFD64825

SEQ ID NO: 69355 - RNA, 1701 nt, Artificial Sequence; identical to SEQ ID NO: 69342
  derived and/or modified sequence opt1 from hemagglutinin__InfluenzaA__AFD64827

SEQ ID NO: 69356 - RNA, 1701 nt, Artificial Sequence
  derived and/or modified sequence opt1 from hemagglutinin__InfluenzaA__AFD64828
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccccgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 69357 - RNA, 1701 nt, Artificial Sequence; identical to SEQ ID NO: 69351
  derived and/or modified sequence opt1 from hemagglutinin__InfluenzaA__AFD64830

SEQ ID NO: 69358 - RNA, 1701 nt, Artificial Sequence; identical to SEQ ID NO: 67990
  derived and/or modified sequence opt1 from hemagglutinin__InfluenzaA__AFD98095

SEQ ID NO: 69359 - RNA, 1701 nt, Artificial Sequence
  derived and/or modified sequence opt1 from hemagglutinin__InfluenzaA__AFD98106
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 69360 - RNA, 1701 nt, Artificial Sequence
  derived and/or modified sequence opt1 from hemagglutinin__InfluenzaA__AFD98128
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcaacagcccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgcaagagcaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcgcaucaccguguccacgaagcggagccagcaggccgugaucccgaacaucggcucccgcccccggguccgcaacauccccagccgggugagcaucuacuggaccaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgccugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacagcgaggggcgcggccaggccgccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcucaagagcggcuacaaggacuggauccuguggaucuccuucgcgaucagcugcuuccugcugugcgucgcccugcucggcuucaucaugugggccugccagaaggggaacauccgcugcaacaucugcaucuga

SEQ ID NO: 69361 - RNA, 1701 nt, Artificial Sequence; identical to SEQ ID NO: 67990
  derived and/or modified sequence opt1 from hemagglutinin__InfluenzaA__AFD98139

SEQ ID NO: 69362 - RNA, 1701 nt, Artificial Sequence
  derived and/or modified sequence opt1 from hemagglutinin__InfluenzaA__AFD98161
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccgccggggagaucugcgacagcccccaccacauccucgacggcgagaacugcacccugaucgacgcccugcucggggacccccagugcgacggcuuccagaacaagaagugggaccuguucguggagcgcucccgggcguacagcaacugcuaccccuacgacgugccggacuacgccucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcgcaucaccgugagcaccaagcggucccagcaggccgugaucccgaacaucggcagccgcccccggguccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcgcccaucgggaagugcaacuccgagugcaucacccccaacggcagcauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggcgcggccaggcggccgaccugaaguccacccaggccgccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 69363 - RNA, 1701 nt, Artificial Sequence
  derived and/or modified sequence opt1 from hemagglutinin__InfluenzaA__AFD98172
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaagggggucgagcugaaguccggcuacaaggacugggugcuguggaucagcuucgccaucuccugcuuccuccugugcguggcgcugcucggcuucaucaugugggccugccagaaggggaacauccgcugcaacaucugcaucuga

SEQ ID NO: 69364 - RNA, 1701 nt, Artificial Sequence
  derived and/or modified sequence opt1 from hemagglutinin__InfluenzaA__AFD98183
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugcugccgaacaucggcagccggccccgcguccggaacauccccucccgcgugagcaucuacuggaccaucgugaagcccggcgacauccuccugaucaacuccaccgggaaccugaucgccccgcggggcuacuucaagauccgcagcgggaaguccagcaucaugcgguccgacgcccccaucggcaagugcaacagcacgugcaucacccccaacggcuccauccccaacgacaagccguuccagaacgucaaccgcaucaccuacggggcgugcccccgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcccuccugggcuucaucaugugggcgugccagaaggggaacauccggugcaacaucugcaucuga

SEQ ID NO: 69365 - RNA, 1701 nt, Artificial Sequence; identical to SEQ ID NO: 67863
  derived and/or modified sequence opt1 from hemagglutinin__InfluenzaA__AFD98194

SEQ ID NO: 69366 - RNA, 1701 nt, Artificial Sequence; identical to SEQ ID NO: 67917
  derived and/or modified sequence opt1 from hemagglutinin__InfluenzaA__AFD98205

SEQ ID NO: 69367 - RNA, 1701 nt, Artificial Sequence; identical to SEQ ID NO: 69359
  derived and/or modified sequence opt1 from hemagglutinin__InfluenzaA__AFD98215

SEQ ID NO: 69368 - RNA, 1701 nt, Artificial Sequence; identical to SEQ ID NO: 67990
  derived and/or modified sequence opt1 from hemagglutinin__InfluenzaA__AFD98226

SEQ ID NO: 69369 - RNA, 1701 nt, Artificial Sequence
  derived and/or modified sequence opt1 from hemagglutinin__InfluenzaA__AFD98237
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcaacagcccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcguccggaacauccccagccgcguguccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 69370 - RNA, 1701 nt, Artificial Sequence; identical to SEQ ID NO: 69362
  derived and/or modified sequence opt1 from hemagglutinin__InfluenzaA__AFD98248

SEQ ID NO: 69371 - RNA, 1701 nt, Artificial Sequence
  derived and/or modified sequence opt1 from hemagglutinin__InfluenzaA__AFD98259
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagcaaggcguacuccaacugcuaccccuacgacgugcaggacuacgccagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaacuucaaguacccggcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcagccagcaggccgugauccccaacaucggcagccggccgcgcguccggaacauccccucccgcaucagcaucuacuggacgaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgucaagcagagcacgcugaagcucgccaccggcaugcgcaacgugcccgagaagcagacccgggggaucuucggcgccaucgccggguucaucgagaacggcugggagggcaugauggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 69372 - RNA, 1701 nt, Artificial Sequence
  derived and/or modified sequence opt1 from hemagglutinin__InfluenzaA__AFD98270
augaaggccauccuggugguccuccuguacaccuucgugaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcgugacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgucagcuccuucgagcgcuucgagaucuuccccaacaccagcuccuggcccaaccacgacagcaacaagggcgugaccgccgcgugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcacgaccgccgaccagcagucccuguaccagaacgcggacgccuacguguucgucggcaccagccgguacuccaagaaguucaagcccgagaucgccauccgcccgaaggugcgggaccaggagggccgcaugaacuacuacuggacccugguggagcccggggacaagaucacguucgaggccaccggcaaccucgucgugccccgguacgccuucgcgauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggccagcucccuggugcucgucgugagccugggggcgaucagcuucuggaugugcuccaacggcagccugcagugccggaucugcaucuga

SEQ ID NO: 69373 - RNA, 1701 nt, Artificial Sequence
  derived and/or modified sequence opt1 from hemagglutinin__InfluenzaA__AFD98280
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgacagccuguccaccgcccggagcugguccuacaucguggagaccagcuccagcgacaacggcacgugcuaccccggcgacuucaucgacuacgaggagcuccgcgagcagcuguccagcguguccagcuucgagcgguucgagaucuuccccaagaccuccagcuggcccaaccacgacuccaacaagggggucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccaccacggccgaccagcagagccuguaccagaacgccgacaccuacguguucgugggcaccagccgcuacuccaagaaguucaagcccgagaucgccauccggccgaagguccgcgaccaggaggggcggaugaacuacuacuggacccugguggagcccggcgacaagaucacguucgaggccaccgggaaccucguggucccccgcuacgcguucgccauggagcggaacgccggcagcggcaucaucaucuccgacacccccgugcacgacugcaacaccacgugccagaccccgaagggggccaucaacaccagccugcccuuccagaacauccaccccaucaccaucggcaagugccccaaguacgugaaguccacgaagcugcgccucgccaccgggcugcggaacgucccgagcauccagucccgcggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggccaucuacuccaccgucgcgagcucccuggugcucguggucagccugggcgccaucuccuucuggaugugcagcaacggcagccugcagugccgcaucugcaucuga

SEQ ID NO: 69374 - RNA, 1701 nt, Artificial Sequence; identical to SEQ ID NO: 69351
  derived and/or modified sequence opt1 from hemagglutinin__InfluenzaA__AFD98290

SEQ ID NO: 69375 - RNA, 1701 nt, Artificial Sequence; identical to SEQ ID NO: 68094
  derived and/or modified sequence opt1 from hemagglutinin__InfluenzaA__AFD98310

SEQ ID NO: 69376 - RNA, 1701 nt, Artificial Sequence; identical to SEQ ID NO: 67462
  derived and/or modified sequence opt1 from hemagglutinin__InfluenzaA__AFD98320

SEQ ID NO: 69377 - RNA, 1701 nt, Artificial Sequence; identical to SEQ ID NO: 69362
  derived and/or modified sequence opt1 from hemagglutinin__InfluenzaA__AFD98340

SEQ ID NO: 69378 - RNA, 1701 nt, Artificial Sequence
  derived and/or modified sequence opt1 from hemagglutinin__InfluenzaA__AFD98351
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggaccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 69379 - RNA, 1701 nt, Artificial Sequence
  derived and/or modified sequence opt1 from hemagglutinin__InfluenzaA__AFD98362
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacaacuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccuccgggcggaucaccgugagcaccaagcgcggccagcaggccgugaucccgaacaucggcucccggccccgcguccggaacauccccagccgcaucagcaucuacuggacgaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgcgugcccccgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucgucggcaagacgaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 69380 - RNA, 1701 nt, Artificial Sequence; identical to SEQ ID NO: 69359
  derived and/or modified sequence opt1 from hemagglutinin__InfluenzaA__AFD98373

SEQ ID NO: 69381 - RNA, 1701 nt, Artificial Sequence; identical to SEQ ID NO: 67990
  derived and/or modified sequence opt1 from hemagglutinin__InfluenzaA__AFD98384

SEQ ID NO: 69382 - RNA, 1701 nt, Artificial Sequence
  derived and/or modified sequence opt1 from hemagglutinin__InfluenzaA__AFD98395
augaagaccaucaucgcccugagcuacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagaacagcuccgccggggagaucugcgacagcccccaccacauccucgacggcgagaacugcacccugaucgacgcccugcucggggacccccagugcgacggcuuccagaacaagaagugggaccuguucguggagcgcucccgggcguacagcaacugcuaccccuacgacgugccggacuacgccucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcgcaucaccgugagcaccaagcggucccagcaggccgugaucccgaacaucggcagccgcccccggguccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcgcccaucgggaagugcaacuccgagugcaucacccccaacggcagcauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggcgcggccaggcggccgaccugaaguccacccaggccgccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 69383 - RNA, 1701 nt, Artificial Sequence; identical to SEQ ID NO: 69359
  derived and/or modified sequence opt1 from hemagglutinin__InfluenzaA__AFD98406

SEQ ID NO: 69384 - RNA, 1701 nt, Artificial Sequence; identical to SEQ ID NO: 69362
  derived and/or modified sequence opt1 from hemagglutinin__InfluenzaA__AFD98417

SEQ ID NO: 69385 - RNA, 1701 nt, Artificial Sequence
  derived and/or modified sequence opt1 from hemagglutinin__InfluenzaA__AFD98428
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucacgaucagcugcuuccuccugugcgucgcccugcucggcuucaucaugugggcgugccagaaggggaacauccggugcaacaucugcaucuga

SEQ ID NO: 69386 - RNA, 1701 nt, Artificial Sequence; identical to SEQ ID NO: 67875
  derived and/or modified sequence opt1 from hemagglutinin__InfluenzaA__AFD98439

SEQ ID NO: 69387 - RNA, 1701 nt, Artificial Sequence
  derived and/or modified sequence opt1 from hemagglutinin__InfluenzaA__AFD98449
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagaacuucaacuggaccggggugacccagaacggcaccagcuccgccugcauccgccggagcaagaacuccuucuucagccgccugaacuggcucacgcaccugaacuucaaguuccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgccaucccgaacaucggcagccggccccgcgugcggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 69388 - RNA, 1701 nt, Artificial Sequence
  derived and/or modified sequence opt1 from hemagglutinin__InfluenzaA__AFD98460
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucuccaagcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcagccagcaggccgugaucccgaacaucggcagccggccccgcguccggaacauccccucccgcaucagcaucuacuggacgaucgugaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucaccuacggggccugcccccgguacgucaagcagagcacgcugaagcucgccaccggcaugcgcaacgugcccgagaagcagacccgggggaucuucggcgccaucgccggguucaucgagaacggcugggagggcaugauggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacguguaccgggacgaggcccucuccaaccgcuuccagaucaagggggucgagcucaagagcggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 69389 - RNA, 1701 nt, Artificial Sequence; identical to SEQ ID NO: 67875
  derived and/or modified sequence opt1 from hemagglutinin__InfluenzaA__AFD98471

SEQ ID NO: 69390 - RNA, 1701 nt, Artificial Sequence
  derived and/or modified sequence opt1 from hemagglutinin__InfluenzaA__AFD98481
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcaacagcccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccguguccacgaagcgcagccagcaggccgugaucccgaacaucggcucccggccccgcguccggaacauccccagccgcgugagcaucuacuggaccaucgugaagcccggcgacauccugcucaucaacuccaccgggaaccugaucgccccgcggggcuacuucaagauccgcagcgggaaguccagcgucaugcgguccgacgcgcccaucggcaagugcaacagcgccugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgcgggguucaucgagaacggcugggagggcaugguggacgggugguacggcuuccgccaccagaacagcgaggggcggggccaggccgccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgcggagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcucaagagcggcuacaaggacuggauccuguggaucuccuucgcgaucagcugcuuccugcugugcguggcccugcucggcuucaucaugugggccugccagaaggggaacauccggugcaacaucugcaucuga

SEQ ID NO: 69391 - RNA, 1701 nt, Artificial Sequence; identical to SEQ ID NO: 67990
  derived and/or modified sequence opt1 from hemagglutinin__InfluenzaA__AFD98492

SEQ ID NO: 69392 - RNA, 1701 nt, Artificial Sequence
  derived and/or modified sequence opt1 from hemagglutinin__InfluenzaA__AFD98503
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagaccaaggggaucuucggcgccaucgccggguucaucgagaacggcugggagggcaugauggacgggugguacggcuuccgccaccagaacuccgaggggcggggccaggcggccgaccugaaguccacccaggccgccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 69393 - RNA, 1701 nt, Artificial Sequence; identical to SEQ ID NO: 67990
  derived and/or modified sequence opt1 from hemagglutinin__InfluenzaA__AFD98514

SEQ ID NO: 69394 - RNA, 1701 nt, Artificial Sequence; identical to SEQ ID NO: 69342
  derived and/or modified sequence opt1 from hemagglutinin__InfluenzaA__AFD98525

SEQ ID NO: 69395 - RNA, 1701 nt, Artificial Sequence; identical to SEQ ID NO: 67863
  derived and/or modified sequence opt1 from hemagglutinin__InfluenzaA__AFD98558

SEQ ID NO: 69396 - RNA, 1701 nt, Artificial Sequence
  derived and/or modified sequence opt1 from hemagglutinin__InfluenzaA__AFD98569
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccagcgggcggaucacgguguccaccaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacgagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69397 - RNA, 1701 nt, Artificial Sequence; identical to SEQ ID NO: 67863
  derived and/or modified sequence opt1 from hemagglutinin__InfluenzaA__AFD98580

SEQ ID NO: 69398 - RNA, 1701 nt, Artificial Sequence
  derived and/or modified sequence opt1 from hemagglutinin__InfluenzaA__AFE02942
augaaggccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgcgagcuccuggagcuacaucgucgagaccuccaacagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggugaccgccgccugcccgcacgccggcgccaagagcuucuacaagaaccucaucuggcuggucaagaaggggaacuccuaccccaagcugagcaaguccuacaucaacgacaagggcaaggaggugcucgugcugugggggauccaccaccccagcaccagcgccgaccagcagucccuguaccagaacgccgacgccuacgucuucguguggacgagccgguacuccaagaaguucaagcccgagaucgccauccgcccgaaggugcgggaccaggagggccgcaugaacuacuacuggacccucgucgagcccggcgacaagaucaccuucgaggcgaccgggaaccugguggugccccgguacgccuucgccauggaccgcaacgccggcagcgggaucaucaucuccgacacgcccguccacgacugcaacacgaccugccagaccccgaagggcgccaucaacaccagccugcccuuccagaacauccaccccaucaccaucggcaagugccccaaguacgugaaguccaccaagcuccggcuggcgaccgggcugcgcaacgugccgagcauccagucccggggccucuucggggccaucgccggcuucaucgagggcggguggacgggcauggucgacgggugguacggcuaccaccaccagaacgagcaggggagcggcuacgccgccgaccugaaguccacccagaacgcgaucgacgagaucaccaacaaggugaacagcgugaucgagaagaugaacacccaguucacggccgucgggaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggccaagcucaaccgggaggagaucgacggggugaagcuggaguccacccgcaucuaccagauccuggcgaucuacagcaccguggccuccagccucguccugguggugagccugggcgccaucuccuucuggaugugcagcaacgggucccuccagugccggaucugcaucuga

SEQ ID NO: 69399 - RNA, 1701 nt, Artificial Sequence; identical to SEQ ID NO: 64841
  derived and/or modified sequence opt1 from hemagglutinin__InfluenzaA__AFE18688

SEQ ID NO: 69400 - RNA, 1701 nt, Artificial Sequence; identical to SEQ ID NO: 61658
  derived and/or modified sequence opt1 from hemagglutinin__InfluenzaA__AFE47624

SEQ ID NO: 69401 - RNA, 1701 nt, Artificial Sequence; identical to SEQ ID NO: 62408
  derived and/or modified sequence opt1 from hemagglutinin__InfluenzaA__AFE47635

SEQ ID NO: 69402 - RNA, 1701 nt, Artificial Sequence; identical to SEQ ID NO: 67990
  derived and/or modified sequence opt1 from hemagglutinin__InfluenzaA__AFF18506

SEQ ID NO: 69403 - RNA, 1701 nt, Artificial Sequence
  derived and/or modified sequence opt1 from hemagglutinin__InfluenzaA__AFF57124
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccacggccgaccagcagcggcuguaccagaacgccgacgccuacguguucguggggaccucccgcuacagcaagaaguucaagcccgagaucgccauccggccgaagguccgcgaccaggagggccggaugaacuacuacuggacccugguggagcccggcgacaagaucaccuucgaggcgacggggaaccucguggucccccgcuacgccuucgccauggagcggaacgccggcuccgggaucaucaucagcgacacccccgugcacgacugcaacacgaccugccagaccccgaagggcgccaucaacaccucccugcccuuccagaacauccaccccaucaccaucggcaagugccccaaguacgucaagagcaccaagcugcgccucgcgacggggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucaccaacaaggugaacuccgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccuccagccuggugcucguggucucccugggcgccaucagcuucuggaugugcagcaacgggucccugcagugccgcaucugcaucuga

SEQ ID NO: 69404 - RNA, 1701 nt, Artificial Sequence
  derived and/or modified sequence opt1 from hemagglutinin__InfluenzaA__AFF57128
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcaguccaucuaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucaccaucgggaagugccccaaguacgugaaguccaccaagcugcggcuggcgacgggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccaacaaggugaacagcgucaucgagaagaugaacacgcaguucaccgccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcucccuggugcugguggucagccucggggccaucagcuucuggaugugcuccaacggcagccugcagugccggaucugcaucuga

SEQ ID NO: 69405 - RNA, 1701 nt, Artificial Sequence
  derived and/or modified sequence opt1 from hemagglutinin__InfluenzaA__AFF57132
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagcaucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacgagaccuacgacuaccccaaguacagcgaggaggccaagcugaaccgggaggagaucgacggcgugaagcuggaguccacccgcaucuaccagauccucgccaucuacagcaccgucgcguccagccuggugcugguggucucccucggggccaucagcuucuggaugugcagcaacggcucccugcagugccggaucugcaucuga

SEQ ID NO: 69406 - RNA, 1701 nt, Artificial Sequence
  derived and/or modified sequence opt1 from hemagglutinin__InfluenzaA__AFF57136
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccguguacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 69407 - RNA, 1701 nt, Artificial Sequence
  derived and/or modified sequence opt1 from hemagglutinin__InfluenzaA__AFF57144
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgacgaccagcagagccuguaccagaacgaggacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgccuucgcgauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgagcauccagucccgcgggcuguucggcgccaucgcgggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgccagcucccuggugcucguggucagccugggggcgaucuccuucuggaugugcagcaacggcucccugcagugccgcaucugcaucuga

SEQ ID NO: 69408 - RNA, 1701 nt, Artificial Sequence
  derived and/or modified sequence opt1 from hemagglutinin__InfluenzaA__AFF57148
augaaggccauccuggugguccuccuguacaccuucgccaccgcgaacgccgacacgcugugcaucggcuaccacgccaacaacagcaccgacaccguggacacccuccuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccucaucuggcuggucaagaaggggaacagcuaccccaagcuguccaagagcuacaucaacgacaagggcaaggaggugcucgugcugugggggauccaccaccccagcaccuccgacgaccagcagagccuguaccagaacgaggacgccuacgucuucgugggcuccagccgguacuccaagaaguucaagcccgagaucgccauccgcccgaaggugcgggaccgcgagggccggaugaacuacuacuggacgcucgucgagcccggggacaagaucaccuucgaggccaccggcaaccugguggugccccgcuacgccuucgcgauggagcggaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcuccgccuggccaccggccugcggaacgugccgagcauccagucccgcggccucuucggggccaucgcgggguucaucgagggcggcuggaccgggauggucgacggcugguacggguaccaccaccagaacgagcagggcagcggguacgccgccgaccugaaguccacgcagaacgccaucgacgagaucaccaacaaggugaacagcgugaucgagaagaugaacacccaguucaccgccgucggcaaggaguucaaccaccuggagaagcggaucgagaaccucaacaagaagguggacgacggcuuccuggacaucuggacguacaacgcggagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgcgaggagaucgacggcgugaagcuggaguccacccggaucuaccagauccuggccaucuacagcaccguggccagcucccucguccugguggugagccugggggcgaucuccuucuggaugugcagcaacggcucccuccagugccgcaucugcaucuga

SEQ ID NO: 69409 - RNA, 1701 nt, Artificial Sequence
  derived and/or modified sequence opt1 from hemagglutinin__InfluenzaA__AFF57160
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccgagagcuacaucaacgacaagggcaaggaggugcugguccucugggggauccaccaccccagcaccuccgccgaccagcagagccuguaccagaacgaggacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgcguucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 69410 - RNA, 1701 nt, Artificial Sequence
  derived and/or modified sequence opt1 from hemagglutinin__InfluenzaA__AFF57164
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgagaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggguccagccgguacuccaagaaguucaagcccgagaucgccauccgcccgaagguccgggaccgcgagggccggaugaacuacuacuggacgcugguggagcccggcgacaagaucaccuucgaggcgaccgggaaccucguggucccccgcuacgccuucgccauggagcggaacgccggcagcgggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacgggucccugcagugccgcaucugcaucuga

SEQ ID NO: 69411 - RNA, 1701 nt, Artificial Sequence; identical to SEQ ID NO: 69410
  derived and/or modified sequence opt1 from hemagglutinin__InfluenzaA__AFF57168

SEQ ID NO: 69412 - RNA, 1701 nt, Artificial Sequence
  derived and/or modified sequence opt1 from hemagglutinin__InfluenzaA__AFF57172
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgaggacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgcguucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 69413 - RNA, 1701 nt, Artificial Sequence
  derived and/or modified sequence opt1 from hemagglutinin__InfluenzaA__AFF57176
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagagccuguaccagaacgccgacgccuacguguucgugggguccagccgguacuccaagaaguucaagcccgagaucgccauccgcccgaagguccgggaccgcgagggccggaugaacuacuacuggacgcugguggagcccggcgacaagaucaccuucgaggcgaccgggaaccucguggucccccgcuacgccuucgccauggagcggaacgccggcagcgggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacgggucccugcagugccgcaucugcaucuga

SEQ ID NO: 69414 - RNA, 1701 nt, Artificial Sequence
  derived and/or modified sequence opt1 from hemagglutinin__InfluenzaA__AFF57184
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccagaagcuguccaagagcuacaucaacgacaaggggaaggaggugcugguccucuggggcauccaccaccccagcaccuccgccgaccagcagagccuguaccagaacgccgacgccuacguguucgugggguccagccgguacuccaagaaguucaagcccgagaucgccauccgccccaagguccgggaccgcgagggccggaugaacuacuacuggacgcugguggagccgggcgacaagaucaccuucgaggcgaccgggaaccucguggucccccgcuacgccuucgccauggagcggaacgccggcagcgggaucaucaucuccgacacccccgugcacgacugcaacacgaccugccagacccccaagggcgccaucaacaccagccugccguuccagaacauccaccccaucacgaucggcaagugccccaaguacgugaaguccaccaagcugcgccucgcgaccgggcugcggaacguccccagcauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuacccgaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacgggucccugcagugccgcaucugcaucuga

SEQ ID NO: 69415 - RNA, 1701 nt, Artificial Sequence; identical to SEQ ID NO: 69407
  derived and/or modified sequence opt1 from hemagglutinin__InfluenzaA__AFF57188

SEQ ID NO: 69416 - RNA, 1707 nt, Artificial Sequence
  derived and/or modified sequence opt1 from hemagglutinin__InfluenzaA__AFF60787
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccgaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 69417 - RNA, 1701 nt, Artificial Sequence
  derived and/or modified sequence opt1 from hemagglutinin__InfluenzaA__AFG29042
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuucuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccgggagcggcaucaucaucuccgacacgcccguccacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 69418 - RNA, 1701 nt, Artificial Sequence
  derived and/or modified sequence opt1 from hemagglutinin__InfluenzaA__AFG29044
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacccccaacuccgacaacggcacgugcuaccccggcgacuucaucgacuacgaggagcuccgggagcagcugagcuccgugagcuccuucgagcgcuucgagaucuuccccaagaccagcuccuggccgaaccacgacagcaacaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccacccgcccaccuccacggaccagcagagccuguaccagaacgccgacgccuacguguucgugggcaccagccgguacuccaagaaguucaagcccgagaucgccauccgccccaagguccggggccaggaggggcgcaugaacuacuacuggacccugguggagcccggcgacaagaucaccuucgaggccacggggaaccucguggucccgcgguacgcguucgccauggagcgcaacgccggcagcggcaucaucaucuccgacacccccgugcacgacugcaacacgaccugccagacccccaagggggccaucaacaccagccugcccuuccagaacauccacccgaucaccaucggcaagugccccaaguacgugaaguccaccaagcugcggcucgccacggggcugcgcaacguccccagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 69419 - RNA, 1701 nt, Artificial Sequence; identical to SEQ ID NO: 63677
  derived and/or modified sequence opt1 from hemagglutinin__InfluenzaA__AFG31060

SEQ ID NO: 69420 - RNA, 1701 nt, Artificial Sequence; identical to SEQ ID NO: 66232
  derived and/or modified sequence opt1 from hemagglutinin__InfluenzaA__AFG31070

SEQ ID NO: 69421 - RNA, 1701 nt, Artificial Sequence; identical to SEQ ID NO: 63664
  derived and/or modified sequence opt1 from hemagglutinin__InfluenzaA__AFG31080

SEQ ID NO: 69422 - RNA, 1701 nt, Artificial Sequence
  derived and/or modified sequence opt1 from hemagglutinin__InfluenzaA__AFG31100
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgaccugaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugaucgugagccugggggccaucuccuucuggaugugcagcaacggcucccuccagugccggaucugcaucuga

SEQ ID NO: 69423 - RNA, 1701 nt, Artificial Sequence; identical to SEQ ID NO: 63677
  derived and/or modified sequence opt1 from hemagglutinin__InfluenzaA__AFG31110

SEQ ID NO: 69424 - RNA, 1701 nt, Artificial Sequence; identical to SEQ ID NO: 63919
  derived and/or modified sequence opt1 from hemagglutinin__InfluenzaA__AFG31120

SEQ ID NO: 69425 - RNA, 1701 nt, Artificial Sequence; identical to SEQ ID NO: 63919
  derived and/or modified sequence opt1 from hemagglutinin__InfluenzaA__AFG31130

SEQ ID NO: 69426 - RNA, 1701 nt, Artificial Sequence; identical to SEQ ID NO: 63919
  derived and/or modified sequence opt1 from hemagglutinin__InfluenzaA__AFG31140

SEQ ID NO: 69427 - RNA, 1701 nt, Artificial Sequence; identical to SEQ ID NO: 64779
  derived and/or modified sequence opt1 from hemagglutinin__InfluenzaA__AFG31150

SEQ ID NO: 69428 - RNA, 1701 nt, Artificial Sequence; identical to SEQ ID NO: 64779
  derived and/or modified sequence opt1 from hemagglutinin__InfluenzaA__AFG31160

SEQ ID NO: 69429 - RNA, 1701 nt, Artificial Sequence; identical to SEQ ID NO: 63677
  derived and/or modified sequence opt1 from hemagglutinin__InfluenzaA__AFG31170

SEQ ID NO: 69430 - RNA, 1701 nt, Artificial Sequence; identical to SEQ ID NO: 63677
  derived and/or modified sequence opt1 from hemagglutinin__InfluenzaA__AFG31180

SEQ ID NO: 69431 - RNA, 1701 nt, Artificial Sequence; identical to SEQ ID NO: 63677
  derived and/or modified sequence opt1 from hemagglutinin__InfluenzaA__AFG31190

SEQ ID NO: 69432 - RNA, 1701 nt, Artificial Sequence; identical to SEQ ID NO: 63677
  derived and/or modified sequence opt1 from hemagglutinin__InfluenzaA__AFG31200

SEQ ID NO: 69433 - RNA, 1701 nt, Artificial Sequence; identical to SEQ ID NO: 63677
  derived and/or modified sequence opt1 from hemagglutinin__InfluenzaA__AFG31210

SEQ ID NO: 69434 - RNA, 1701 nt, Artificial Sequence; identical to SEQ ID NO: 63677
  derived and/or modified sequence opt1 from hemagglutinin__InfluenzaA__AFG31220

SEQ ID NO: 69435 - RNA, 1701 nt, Artificial Sequence; identical to SEQ ID NO: 66232
  derived and/or modified sequence opt1 from hemagglutinin__InfluenzaA__AFG31230

SEQ ID NO: 69436 - RNA, 1701 nt, Artificial Sequence; identical to SEQ ID NO: 63677
  derived and/or modified sequence opt1 from hemagglutinin__InfluenzaA__AFG31240

SEQ ID NO: 69437 - RNA, 1701 nt, Artificial Sequence; identical to SEQ ID NO: 63677
  derived and/or modified sequence opt1 from hemagglutinin__InfluenzaA__AFG31250

SEQ ID NO: 69438 - RNA, 1701 nt, Artificial Sequence; identical to SEQ ID NO: 63677
  derived and/or modified sequence opt1 from hemagglutinin__InfluenzaA__AFG31260

SEQ ID NO: 69439 - RNA, 1701 nt, Artificial Sequence; identical to SEQ ID NO: 63677
  derived and/or modified sequence opt1 from hemagglutinin__InfluenzaA__AFG31270

SEQ ID NO: 69440 - RNA, 1701 nt, Artificial Sequence; identical to SEQ ID NO: 63677
  derived and/or modified sequence opt1 from hemagglutinin__InfluenzaA__AFG31280

SEQ ID NO: 69441 - RNA, 1701 nt, Artificial Sequence; identical to SEQ ID NO: 63677
  derived and/or modified sequence opt1 from hemagglutinin__InfluenzaA__AFG31290

SEQ ID NO: 69442 - RNA, 1701 nt, Artificial Sequence
  derived and/or modified sequence opt1 from hemagglutinin__InfluenzaA__AFG31300
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacaucaaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 69443 - RNA, 1701 nt, Artificial Sequence; identical to SEQ ID NO: 66232
  derived and/or modified sequence opt1 from hemagglutinin__InfluenzaA__AFG31310

SEQ ID NO: 69444 - RNA, 1701 nt, Artificial Sequence; identical to SEQ ID NO: 63677
  derived and/or modified sequence opt1 from hemagglutinin__InfluenzaA__AFG31323

SEQ ID NO: 69445 - RNA, 1701 nt, Artificial Sequence; identical to SEQ ID NO: 63677
  derived and/or modified sequence opt1 from hemagglutinin__InfluenzaA__AFG31333

SEQ ID NO: 69446 - RNA, 1701 nt, Artificial Sequence; identical to SEQ ID NO: 63677
  derived and/or modified sequence opt1 from hemagglutinin__InfluenzaA__AFG31343

SEQ ID NO: 69447 - RNA, 1701 nt, Artificial Sequence; identical to SEQ ID NO: 63677
  derived and/or modified sequence opt1 from hemagglutinin__InfluenzaA__AFG31353

SEQ ID NO: 69448 - RNA, 1701 nt, Artificial Sequence; identical to SEQ ID NO: 63677
  derived and/or modified sequence opt1 from hemagglutinin__InfluenzaA__AFG31363

SEQ ID NO: 69449 - RNA, 1701 nt, Artificial Sequence; identical to SEQ ID NO: 63677
  derived and/or modified sequence opt1 from hemagglutinin__InfluenzaA__AFG31376

SEQ ID NO: 69450 - RNA, 1701 nt, Artificial Sequence; identical to SEQ ID NO: 63677
  derived and/or modified sequence opt1 from hemagglutinin__InfluenzaA__AFG31386

SEQ ID NO: 69451 - RNA, 1701 nt, Artificial Sequence; identical to SEQ ID NO: 63677
  derived and/or modified sequence opt1 from hemagglutinin__InfluenzaA__AFG31396

SEQ ID NO: 69452 - RNA, 1701 nt, Artificial Sequence; identical to SEQ ID NO: 63677
  derived and/or modified sequence opt1 from hemagglutinin__InfluenzaA__AFG31406

SEQ ID NO: 69453 - RNA, 1701 nt, Artificial Sequence; identical to SEQ ID NO: 63677
  derived and/or modified sequence opt1 from hemagglutinin__InfluenzaA__AFG31416

SEQ ID NO: 69454 - RNA, 1701 nt, Artificial Sequence; identical to SEQ ID NO: 63677
  derived and/or modified sequence opt1 from hemagglutinin__InfluenzaA__AFG31426

SEQ ID NO: 69455 - RNA, 1701 nt, Artificial Sequence; identical to SEQ ID NO: 63677
  derived and/or modified sequence opt1 from hemagglutinin__InfluenzaA__AFG31436

SEQ ID NO: 69456 - RNA, 1701 nt, Artificial Sequence; identical to SEQ ID NO: 63677
  derived and/or modified sequence opt1 from hemagglutinin__InfluenzaA__AFG31446

SEQ ID NO: 69457 - RNA, 1701 nt, Artificial Sequence; identical to SEQ ID NO: 63677
  derived and/or modified sequence opt1 from hemagglutinin__InfluenzaA__AFG31456

SEQ ID NO: 69458 - RNA, 1701 nt, Artificial Sequence; identical to SEQ ID NO: 63677
  derived and/or modified sequence opt1 from hemagglutinin__InfluenzaA__AFG31466

SEQ ID NO: 69459 - RNA, 1701 nt, Artificial Sequence; identical to SEQ ID NO: 64779
  derived and/or modified sequence opt1 from hemagglutinin__InfluenzaA__AFG31486

SEQ ID NO: 69460 - RNA, 1701 nt, Artificial Sequence; identical to SEQ ID NO: 63677
  derived and/or modified sequence opt1 from hemagglutinin__InfluenzaA__AFG31496

SEQ ID NO: 69461 - RNA, 1701 nt, Artificial Sequence; identical to SEQ ID NO: 63677
  derived and/or modified sequence opt1 from hemagglutinin__InfluenzaA__AFG31506

SEQ ID NO: 69462 - RNA, 1701 nt, Artificial Sequence; identical to SEQ ID NO: 63677
  derived and/or modified sequence opt1 from hemagglutinin__InfluenzaA__AFG31516

SEQ ID NO: 69463 - RNA, 1701 nt, Artificial Sequence; identical to SEQ ID NO: 63768
  derived and/or modified sequence opt1 from hemagglutinin__InfluenzaA__AFG31526

SEQ ID NO: 69464 - RNA, 1701 nt, Artificial Sequence; identical to SEQ ID NO: 63677
  derived and/or modified sequence opt1 from hemagglutinin__InfluenzaA__AFG31536

SEQ ID NO: 69465 - RNA, 1701 nt, Artificial Sequence; identical to SEQ ID NO: 66232
  derived and/or modified sequence opt1 from hemagglutinin__InfluenzaA__AFG31546

SEQ ID NO: 69466 - RNA, 1701 nt, Artificial Sequence; identical to SEQ ID NO: 66232
  derived and/or modified sequence opt1 from hemagglutinin__InfluenzaA__AFG31556

SEQ ID NO: 69467 - RNA, 1701 nt, Artificial Sequence; identical to SEQ ID NO: 63677
  derived and/or modified sequence opt1 from hemagglutinin__InfluenzaA__AFG31566

SEQ ID NO: 69468 - RNA, 1701 nt, Artificial Sequence; identical to SEQ ID NO: 63919
  derived and/or modified sequence opt1 from hemagglutinin__InfluenzaA__AFG31586

SEQ ID NO: 69469 - RNA, 1701 nt, Artificial Sequence; identical to SEQ ID NO: 63919
  derived and/or modified sequence opt1 from hemagglutinin__InfluenzaA__AFG31596

SEQ ID NO: 69470 - RNA, 1701 nt, Artificial Sequence; identical to SEQ ID NO: 63919
  derived and/or modified sequence opt1 from hemagglutinin__InfluenzaA__AFG31606

SEQ ID NO: 69471 - RNA, 1701 nt, Artificial Sequence; identical to SEQ ID NO: 63919
  derived and/or modified sequence opt1 from hemagglutinin__InfluenzaA__AFG31616

SEQ ID NO: 69472 - RNA, 1701 nt, Artificial Sequence; identical to SEQ ID NO: 63919
  derived and/or modified sequence opt1 from hemagglutinin__InfluenzaA__AFG31626

SEQ ID NO: 69473 - RNA, 1701 nt, Artificial Sequence; identical to SEQ ID NO: 63677
  derived and/or modified sequence opt1 from hemagglutinin__InfluenzaA__AFG31636

SEQ ID NO: 69474 - RNA, 1701 nt, Artificial Sequence; identical to SEQ ID NO: 63677
  derived and/or modified sequence opt1 from hemagglutinin__InfluenzaA__AFG31646

SEQ ID NO: 69475 - RNA, 1701 nt, Artificial Sequence; identical to SEQ ID NO: 64841
  derived and/or modified sequence opt1 from hemagglutinin__InfluenzaA__AFG31656

SEQ ID NO: 69476 - RNA, 1701 nt, Artificial Sequence; identical to SEQ ID NO: 64841
  derived and/or modified sequence opt1 from hemagglutinin__InfluenzaA__AFG31666

SEQ ID NO: 69477 - RNA, 1701 nt, Artificial Sequence
  derived and/or modified sequence opt1 from hemagglutinin__InfluenzaA__AFG71865
augaagaccaucaucgcccugagcuacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcaucggcuucuucagccgccucaacuggcugaccaaguccgggagcaccuaccccgugcugaacgucacgaugcccaacaacgacaacuucgacaagcucuacaucuggggcgugcaccacccguccaccaaccaggagcagaccagccuguacgugcaggccuccgggcgggucaccgugagcacgcgccggucccagcagaccaucauccccaacaucggcagccgccccugggugcggggccugagcucccgcaucagcaucuacuggaccaucgucaagcccggggacgugcucgugaucaacuccaacggcaaccugaucgcgccgcggggguacuucaagaugcgcaccggcaagagcuccaucaugcggagcgacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 69478 - RNA, 1701 nt, Artificial Sequence; identical to SEQ ID NO: 62564
  derived and/or modified sequence opt1 from hemagglutinin__InfluenzaA__AFG71876

SEQ ID NO: 69479 - RNA, 1701 nt, Artificial Sequence
  derived and/or modified sequence opt1 from hemagglutinin__InfluenzaA__AFG71898
augaagaccaucaucgcccugagcuaccucuucugccuggccuucggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaccaccgagggguucacguggaccggcgugacccagaacgggggcuccaacgccugcaagcgggggcccggcagcggcuucuucucccgccucaacuggcugaccaagagcggguccacguaccccgugcugaacgucaccaugagcaacaacgacaacuucgacaagcucuacaucuggggcgugcaccaccccuccaccaaccaggagcagaccagccuguacgugcaggccuccgggcgggucacggugagcacccgccggagccagcagaccaucaucccgaacaucggcucccgccccugggugcggggccugagcucccgcaucagcaucuacuggaccaucgucaagcccggggacgugcucgugaucaacuccaacggcaaccugaucgcgccccggggguacuucaagaugcgcacgggcaagagcuccaucaugcggagcgacgccccgaucgacacgugcgucuccgagugcaucacccccaacgggagcauccccaacgacaagcccuuccagaacgugaacaagaucaccuacggcgccugcccgaaguacgugaagcagaacacccugaagcucgccaccggcaugcgcaacguccccgagaagcagacccgggggcuguucggcgccaucgcgggguucaucgagaacggcugggaggggaugaucgacggcugguacggcuuccgccaccagaacuccgaggggaccggccaggccgccgaccucaagagcacgcaggccgccaucgaccagaucaacgggaagcugaaccgggugaucgagaagaccaacgagaaguuccaccagaucgagaaggaguucuccgagguggagggccgcauccaggaccuggagaaguacgucgaggacaccaagaucgaccuguggagcuacaacgcggagcuccugguggcccuggagaaccagcacaccaucgaccucacggacuccgagaugaacaagcuguucgagaagacccggcgccagcugcgggagaacgccgaggacauggggaacggcugcuucaagaucuaccacaagugcgacaacgccugcaucgagagcauccgcaacggcaccuacgaccacgacgucuaccgcgacgaggcccucaacaaccgguuccagaucaaggggguggagcugaaguccggcuacaaggacuggauccuguggaucagcuucgcgaucuccugcuuccuccugugcgugguccugcucggguucaucaugugggccugccagcgcggcaacauccggugcaacaucugcaucuga

SEQ ID NO: 69480 - RNA, 1701 nt, Artificial Sequence
  derived and/or modified sequence opt1 from hemagglutinin__InfluenzaA__AFG71920
augaagaccaucaucgcccugagcuacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccugaucgccuccagcggcacccuggaguucaucaccgagggguucaccuggacgggcgucacccagaacgggggcuccaacgccugcaagcgggggcccggcagcggcuucuucucccgccucaacuggcugaccaagagcggguccaccuaccccgugcugaacgugacgaugcccaacaacgacaacuucgacaagcucuacaucuggggcguccaccacccgagcaccaaccaggagcagaccucccuguacgugcaggccagcgggcgggugaccgucuccacgcgccggagccagcagaccaucauccccaacaucggcagccgccccugggugcggggccuguccagccgcaucuccaucuacuggaccaucgugaagcccggggacguccucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagagcggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 69481 - RNA, 1701 nt, Artificial Sequence
  derived and/or modified sequence opt1 from hemagglutinin__InfluenzaA__AFG71931
augaagaccaucaucgcccugagcuacaucuucugccucgugaucggccaggaccugcccgggaacgagaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaccgagggcuucaccuggacgggggugacccagaacggcggguccaacgccugcaagcggggccccggcaucggguucuucagccgccugaacuggcucaccaaguccggcagcaccuaccccgugcugaacgucacgaugcccaacaacgacaacuucgacaagcuguacaucuggggcgugcaccacccguccaccaaccaggagcagaccagccucuacgugcaggccuccgggcgggucaccgugagcacgcgccggucccagcagaccaucauccccaacaucggcagccgccccugggugcgggggcugagcucccgcaucagcaucuacuggaccaucgucaagcccggcgacgugcuggugaucaacuccaacgggaaccucaucgccccgcggggcuacuucaagaugcgcaccggcaagagcuccaucaugcggagcgacgcgcccaucgacacgugcaucuccgagugcaucacccccaacgggagcauccccaacgacaagccguuccagaacgucaacaagaucaccuacggcgccugccccaaguacgugaagcagaacacccugaagcuggccacggggaugcgcaacgugcccgagaagcagacccggggccucuucggggccaucgccggcuucaucgagaacgggugggagggcaugaucgacggcugguacggguuccgccaccagaacuccgagggcaccgggcaggcggccgaccucaagagcacccaggccgccaucgaccagaucaacggcaagcugaaccgggucaucgagaagacgaacgagaaguuccaccagaucgagaaggaguucuccgagguggaggggcgcauccaggaccucgagaaguacguggaggacaccaagaucgaccuguggagcuacaacgccgagcugcucgucgcgcuggagaaccagcacaccaucgaccugaccgacuccgagaugaacaagcuguucgagaagacgcggcgccagcugcgggagaacgccgaggacaugggcaacggcugcuucaagaucuaccacaagugcgacaacgccugcaucgagagcauccgcaacgggaccuacgaccacgacguguaccgcgacgaggcccugaacaaccgguuccagaucaagggcgucgagcucaaguccggguacaaggacuggauccuguggaucagcuucgccaucuccugcuuccugcucugcguggugcugcugggcuucaucaugugggcgugccagcgcggcaacauccggugcaacaucugcaucuga

SEQ ID NO: 69482 - RNA, 1701 nt, Artificial Sequence
  derived and/or modified sequence opt1 from hemagglutinin__InfluenzaA__AFG71942
augaagaccaucaucgcccugagcuacaucuucuaccucgcccugucccaggaccugcccggcaacgacaacagcaaggcgacccucugccuggggcaccacgccgugccgaacggcacgcuggucaagaccaucaccgacgaccagaccgaggugacgaacgccaccgagcucgugcaguccagcuccaccgggaagaucugcaacaacccccaccgcauccuggacggcauggacugcacccugaucgacgcccuccugggggacccccacugcgacgucuuccagaacgagacgugggaccuguucguggagcggagcaaggccuucuccaacugcuaccccuacgacgugccggacuacgcgagccuccgcucccuggucgccagcuccggcacccuggaguucaucaccgagggcuucaccuggacggaggugacccagaacgggggcagcaucgccugcaagcgggggcccgacuccggcuucuucagccgccucaacuggcugaccaaguccgggcggaccuaccccgugcugaacgucacgaugcccaacaacgacaacuucgacaagcucuacaucuggggcgugcaccacccgagcaccgaccaggagcagaccaaccuguacgugcagaccuccggccgcgucacggugagcacccggcgcucccagcagaccaucauccccaacaucgggagccggcccugggugcgcggccugagcucccggaucagcaucuacuggaccaucgucaagcccggggacgugcucgugaucaacuccaacggcaaccugaucgccccgcgcggcuacuucaagaugcggacgggcaagagcuccaucaugcgcagcgacgcgcccaucgacacgugcaucuccgagugcaucacccccaacgggagcauccccaacgacaagccguuccagaacgucaacaagaucaccuacggggccugccccaaguacgugaagcagaacacccugaagcucgccaccggcaugcggaacgugcccgagaagcagacccgcgggcuguucggcgccaucgccggcuucaucgagaacgggugggagggcaugaucgacgggugguacggcuuccggcaccagaacuccgaggggaccggccaggcggccgaccucaagagcacgcaggccgccaucgaccagaucaacggcaagcugaaccgcaucaucgagaagaccaacgagaaguuccaccagaucgagaaggaguucuccgaggucgaggggcggauccaggaccuggagaaguacguggaggacaccaagaucgaccuguggagcuacaacgccgagcuccugguggcgcuggagaaccagcacaccaucgaccucacggacuccgagaugaacaagcuguucgagaagacccgccggcagcugcgcgagaacgccgaggacaugggcaacgggugcuucaagaucuaccacaagugcgacaacgccugcaucgagagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggcuucaucaugugggcgugccagcgggggaacauccgcugcaacaucugcaucuga

SEQ ID NO: 69483 - RNA, 1701 nt, Artificial Sequence
  derived and/or modified sequence opt1 from hemagglutinin__InfluenzaA__AFG71953
augaagaccaucaucgcccugagcuacaucuucugccucgugcugggccaggaccugcccgggaacgacaaguccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaccgagggcuucaccuggacgggggugacccagaacggcggguccaacgccugcaagcggggccccggcagcggguucuucucccgccucaacuggcugaccaagagcggcuccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgaagcgcagccagcagaccaucauccccaacaucggcagccggcccugggugcgcgggcccuccagccggaucuccaucuacuggaccaccgucaagccgggcgacauccugaucaucaacagcaacgggaaccucaucgcgccccgcggcuacuucaagaugcggacggggaaguccagcaucaugcgcuccgacgcccccaucggcgccugcaucagcgagugcaucacccccaacggcuccaucccgaacgacaagcccuuccagaacgugaacaagaucaccuacggggccugccccaaguacgugaagcagaacacccugaagcuggccacgggcaugcggaacguccccgagaagcagacccgcggccucuucggggccaucgcgggguucaucgagaacggcugggagggcaugaucgacgggugguacggcuuccggcaccagaacagcgaggggaccggccaggccgccgaccugaaguccacccaggccgccaucgaccagaucaacgggaagcugaaccgcgugaucgagaagacgaacgagaaguuccaccagaucgagaaggaguucagcgagguggagggccggauccaggaccucgagaaguacgucgaggacaccaagaucgaccugugguccuacaacgcggagcugcucguggcccuggagaaccagcacaccaucgaccugaccgacagcgagaugaacaagcuguucgagaagacgcgccggcagcuccgcgagaacgccgaggacaugggcaacgggugcuucaagaucuaccacaagugcgacaacgccugcaucggcuccauccggaacgggaccuacgaccacgacguguaccgcgacgaggcccugaacaaccgcuuccagaucaagggcgucgagcucaagagcggcuacaaggacuggauccuguggaucuccuucgcgaucagcugcuuccugcucugcgugguccugcugggggugaucaugugggccugccagaagggcaacauccggugcaacaucugcaucuga

SEQ ID NO: 69484 - RNA, 1701 nt, Artificial Sequence; identical to SEQ ID NO: 61313
  derived and/or modified sequence opt1 from hemagglutinin__InfluenzaA__AFG71975

SEQ ID NO: 69485 - RNA, 1701 nt, Artificial Sequence
  derived and/or modified sequence opt1 from hemagglutinin__InfluenzaA__AFG71996
augaagaccaucaucgcccugagcuacaucuucugccucgugcugggccagaacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacaucggcuucuucagccgccugaacuggcucuacaaguccgggaacaccuaccccgugcugaacgucagcaugcccaacaacgacaacuucgacaagcuguacaucuggggcgugcaccacccguccaccgaccaggagcagaccagccucuacgugcaggccuccgggcgggucacggugagcaccaagcgcucccagcagaccaucauccccaacaucggcagccggcccugggugcgcggccugagcucccggaucagcaucuacuggaccaucgucaagcccggggacauccuggugaucaacuccaacggcaaccucaucgccccgcgcggguacuucaagaugcggacgggcaagagcuccaucaugcgcagcgacgcguccaucgggaccugcaucagcgagugcaucacccccaacggcuccauccccaacgacaagcccuuccagaacgugaacaagaucaccuacggcgccugcccgaaguacgucaagcagaacacgcugaagcuggccaccgggaugcggaacgugcccgagaagcagacccgcggcaucuucggggccaucgccggcuucaucgagaacgggugggagggcaugaucgacggcugguacggguuccggcaccagaacagcgagggcaccgggcaggcggccgaccucaaguccacgcaggccgccaucgaccagaucaacggcaagcugaaccgcaucaucgagaagaccaacgagaaguuccaccagaucgagaaggaguucagcgagguggaggggcggauccaggaccuggagaaguacgucgaggacaccaagaucgaccucugguccuacaacgccgagcugcugguggcgcucgagaaccagcacaccaucgaccugacggacagcgagaugaacaagcuguucgagaagacccgccggcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgcuuccagaucaagggggucgagcucaagagcggcuacaaggacuggauccuguggaucuccuucgccaucagcugcuuccugcugugcgugguccuccugggcuucaucaugugggcgugccagaaggggaacauccggugcaacaucugcaucuga

SEQ ID NO: 69486 - RNA, 1701 nt, Artificial Sequence
  derived and/or modified sequence opt1 from hemagglutinin__InfluenzaA__AFG72007
augaagaccaucaucgcccugagcuacaucuucugccucgugcugggccgcgacuucccccggaacgacaacuccaccgccacgcugugccucgggcaccacgcggucccgaacggcacccuggugaagaccaucaccaacgaccagaucgaggugacgaacgccaccgagcugguccagagcuccagcaccgggaagaucugcaacaacccccaccgcauccucgacggcauggacugcacccugaucgacgcccugcucggggacccccacugcgacggccugcagaacggcacgugggaccuguucguggagcgguccaaggccuucagcaacugcuaccccuacgacgugccggacuacgccucccuccgcagccuggucgcguccagcgggacccuggaguucaucaacgagggcuucaccuggaccggggugacgcagaacggcggguccaacgccugcaagcggggccccgacagcggcuucuucucccgccucaacuggcuguacaagagcgggaacaccuaccccgugcugaacgucaccaugcccaacaacgacaacuucgacaagcucuacaucuggggcgugcaccacccguccaccgaccaggaccagacgagccuguacgugcaggccuccgggcgggucaccgugagcaccaagcgcucccagcagaccgugauccccaacaucggcccccggcccuggguccgcggccugagcagccggaucuccaucuacuggacgaucgugaagccgggggacauccuccugaucaacagcaacggcaaccugaucgcgccccgcggguacuucaagaugcggaccggcaaguccagcaucaugcgcuccgacgcccccaucgggaccugcaucagcgagugcaucacccccaacggcuccaucccgaacgacaagcccuuccagaacgugaacaagaucacguacggcgccugccccaaguacgucaagcagaacacccucaagcuggccaccgggaugcggaacgugcccgagaagcagacccgcggcaucuucggggccaucgccggcuucaucgagaacgggugggagggcaugaucgacggcugguacggguuccggcaccagaacagcgagggcacggggcaggcggccgaccugaaguccacccaggccgccaucgaccagaucaacggcaagcucaaccgcgugaucgagaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacacgaucgaccucaccgacagcgagaugaacaagcuguucgagaagacccgccggcagcugcgcgagaacgccgaggacaugggcaacggcugcuucaagaucuaccaccgcugcgacaacgccugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcgucgugcugcucggcuucaucaugugggcgugccagaaggggaacauccgcugcaacaucugcaucuga

SEQ ID NO: 69487 - RNA, 1701 nt, Artificial Sequence
  derived and/or modified sequence opt1 from hemagglutinin__InfluenzaA__AFG72029
augaagaccaucaucgcccugagcuacaucuucugccucguguucggccagaaccugcccgggaacgacaacuccaccgccacgcugugccucggccaccacgcggucccgaacgggacccuggugaagaccaucaccaacgaccagaucgaggugacgaacgccaccgagcugguccagagcuccagcaccggccgcaucugcgacagcccccaccggauccucgacgggaagaacugcacccugaucgacgcccugcucggcgacccccacugcgacggcuuccagaacgagaagugggaccuguucguggagcgcuccaaggccuucuccaacugcuaccccuacgacgugccggacuacgccagccugcggucccucaucgcgagcuccgggacgcuggaguucaucaacgagggcuucaacuggaccggggucacccagagcggcggguccuacgccugcaagcgcggcagcgacaacuccuucuucagccggcugaacuggcucuacgaguccgagagcaaguaccccgugcugaacgugaccaugcccaacaacggcaacuucgacaagcuguacaucuggggcguccaccaccccuccacggacaaggagcagaccaaccucuacgugcgcgccagcggccgggugaccgucagcaccaagcgcucccagcagacgaucaucccgaacaucgggagccggcccugggugcgcggccuguccagccggaucuccaucuacuggaccaucgugaagcccggcgacauccugcucaucaacagcaacgggaaccugaucgcgccccgcggcuacuucaagauccggaccgggaaguccagcaucaugcgcuccgacgccccgaucgggaccugcagcuccgagugcaucacgcccaacgggagcauccccaacgacaagcccuuccagaacgucaacaagaucaccuacggcgccugcccgaaguacgugaagcagaacacccugaagcucgccaccggcaugcggaacgugcccgagaagcagacgcgcgggaucuucggcgccaucgccggguucaucgagaacggcugggaggggauggucgacggcugguacggcuuccggcaccagaacuccgaggggaccggccaggcggccgaccucaagagcacccaggccgccaucgaccagaucaacgggaagcugaaccgcgugaucgagaagaccaacgagaaguuccaccagaucgagaaggaguucuccgagguggagggccggauccaggaccucgagaaguacgucgaggacacgaagaucgaccuguggagcuacaacgccgagcugcucguggcgcuggagaaccagcacaccaucgaccugaccgacuccgagaugaacaagcuguucgagaagacccgccggcagcugcgcgagaacgccgaggacauggggaacggcugcuucaagaucuaccacaagugcgacaacgccugcaucggcagcauccgcaacgggacguacgaccacgacguguaccgggacgaggcccugaacaaccgcuuccagaucaagggcgucgagcucaaguccggguacaaggacuggauccuguggaucagcuucgccaucagcugcuuccugcucugcgugguccugcugggcuucaucaugugggcgugccagaagggcaacauccggugcaacaucugcaucuga

SEQ ID NO: 69488 - RNA, 1701 nt, Artificial Sequence
  derived and/or modified sequence opt1 from hemagglutinin__InfluenzaA__AFG72040
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccagcuccggcacgcuggaguucaucaacgagagcuucaacuggaccggggugacccaguccggcgggagcuacgccugcaagcgcggcuccgacaacagcuucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccagcggccgggugaccguguccaccaagcgcagccagcagacgaucaucccgaacaucgggucccggcccuggguccgcggccugagcucccggaucagcaucuacuggaccaucgugaagcccggggacauccugcucaucaacuccaacggcaaccugaucgcgccccgcggcuacuucaagauccggaccggcaagagcuccaucaugcgcagcgacgccccgaucgggaccugcuccagcgagugcaucacgcccaacggguccauccccaacgacaagcccuuccagaacgugaacaagaucaccuacggcgccugcccgaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcugaaccgcgucaucgagaagaccaacgagaaguuccaccagaucgagaaggaguucagcgagguggagggccggauccaggaccucgagaaguacguggagaacacgaagaucgaccugugguccuacaacgcggagcugcucgucgcccuggagaaccagcacaccaucgaccugaccgacagcgagaugaacaagcuguucgagaagacccgccggcagcuccgcgagaacgccgaggacauggggaacggcugcuucaagaucuaccacaagugcgacaacgccugcaucggguccauccgcaacggcacguacgaccacgacguguaccgggacgaggcccugaacaaccgcuuccagaucaagggcgucgagcucaagagcggguacaaggacuggauccuguggaucagcuucgcgaucuccugcuuccugcucugcguggugcugcugggcuucaucaugugggccugccagaaggggaacauccggugcaacaucugcaucuga

SEQ ID NO: 69489 - RNA, 1701 nt, Artificial Sequence
  derived and/or modified sequence opt1 from hemagglutinin__InfluenzaA__AFG72051
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccagcuccggcacgcuggaguucaucaacgagagcuucaacuggaccggggugacccaguccggcgggagcuacgccugcaagcgcggcuccgacaacagcuucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccagcggccgggugaccguguccaccaagcgcaaccagcagacggucaucccgaacaucgggagccggcccugggugcgcggccuguccagccggaucuccaucuacuggaccaucgugaagcccggggacauccugcucaucaacagcaacggcaaccugaucgcgccccgcggcuacuucaagauccacaacgggaaguccagcaucaugcgguccgacgccccgaucgggaccugcagcuccgagugcaucacccccaacggcagcauccccaacgacaagcccuuccagaacgucaacaagaucacguacggcgccugcccgaaguacgugaagcagaacacccugaagcucgccaccgggaugcgcaacgugcccgagaagcagacccggggcaucuucggcgccaucgcgggguucaucgagaacggcugggaggggauggucgacggcugguacggguuccgccaccggaacuccgagggcacgggccaggccgccgaccucaagagcacccaggccgccaucgaccagaucaacgggaagcugaaccgcgugaucgagaagaccaacgagaaguuccaccagaucgagaaggaguucuccgagguggagggccggauccaggaccucgagaaguacgucgaggacaccaagaucgaccuguggagcuacaacgcggagcugcucguggcccuggagaaccagcacacgaucgaccugaccgacuccgagaugaacaagcuguucgagaagacccgccggcagcugcgcgagaacgccgaggacauggggaacggcugcuucaagaucuaccacaagugcgacaacgccugcaucgggagcauccgcaacggcaccuacgaccacgacgucuaccgggacgaggcccugaacaaccgcuuccagaucaagggcguggagcucaaguccggguacaaggacuggauccuguggaucagcuucgcgaucagcugcuuccugcucugcgugguccugcugggcuucaucaugugggccugccagaaggggaacauccggugcaacaucugcaucuga

SEQ ID NO: 69490 - RNA, 1701 nt, Artificial Sequence
  derived and/or modified sequence opt1 from hemagglutinin__InfluenzaA__AFG72085
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaucggggugacccagagcggcggguccugcgccugcaagcgcggcagcgugaacuccuucuucagccggcugaacuggcuccacgaguccgagcagaaguaccccgcccugaacgucaccaugcccaacaacgggaaguucgacaagcuguacaucuggggcgugcaccaccccagcaccgaccgcgagcagacgaaccucuacgugcgggcguccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaucggcaaccugaucgcgccccggggcuacuucaagauccgcaccggcaagagcuccaucaugcggagcgacgccccgaucgggaccugcuccagcgagugcaucacccccaacggguccauccccaacgacaagcccuuccagaacgugaacaagaucacguacggcgccugcccgcgcuacgucaagcagaacacccugaagcucgccaccgggaugcggaacgugcccgagaagcagacccgcggcaucuucggcgccaucgccggguucaucgagaacggcugggaggggaugguggacggcugguacggguuccggcaccagaacagcgagggcacgggccaggccgccgaccugaaguccacccaggccgcgaucgaccagaucaacgggaagcugaaccgccucaucgagaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagacccgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 69491 - RNA, 1701 nt, Artificial Sequence
  derived and/or modified sequence opt1 from hemagglutinin__InfluenzaA__AFG72107
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucaucgccagcuccggcacgcuggaguucaucaacgaggaguucaacuggaccggggucacccagaacggcgggagcuacgccugcaagcgcggcuccgugaacagcuucuucucccggcugaacuggcuccacgagagcgaguacaaguaccccgcccugaacgugaccaugcccaacaacgggcgcuucgacaagcuguacaucuggggcguccaccaccccuccacggaccgggagcagaccaaccucuacgugcgcgcgagcggccgggugaccgucuccaccaagcgcagccagcagacggugaucccgaacaucgggccccggcccugggugcgcggccugagcucccggaucagcaucuacuggaccaucgucaagcccggggacauccugcucaucaacuccaccggcaaccugaucgccccgcgcggcuacuucaagauccacaccgggaaguccuccaucaugcggagcgacgcccccaucggcacgugcuccagcgagugcaucacccccaacggguccauccccaacgacaagccguuccagaacgugaacaagaucaccuacggcgccugcccccgcuacgugaagcagaacacccugaagcucgccacggggaugcggaacguccccgagaagcagacccgcggcaucuucggcgcgaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacguguaccgcgacgaggcggucaacaaccgguuccagaucaagggcguggagcucaagagcggguacaaggacuggauccuguggaucuccuucgccaucagcugcuuccugcucugcgucauccugcugggcuucaucaugugggccugccagaaggggaacauccgcugcaacaucugcaucuga

SEQ ID NO: 69492 - RNA, 1701 nt, Artificial Sequence
  derived and/or modified sequence opt1 from hemagglutinin__InfluenzaA__AFG72118
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaacagcuccaccgggcgcaucugcaacagcccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaucaacgaggacuucaacuggaccgggguggcccaguccggcgggagcuacgccugcaagcgcggcuccgugaacagcuucuucucccggcugaacuggcuccacgagagcgaguacaaguaccccgcgcugaacgucaccaugcccaacaacgggaaguucgacaagcuguacaucuggggcgugcaccaccccuccaccgaccgcgagcagacgaaccucuacgugcgggccagcggccgcgucaccguguccaccaagcggagccagcagaccgugaucccgaacaucgggagccgccccuggguccggggccuguccagccgcaucuccaucuacuggacgaucgugaagcccggggacauccugcucaucaacagcaccggcaaccugaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaaccgcaucaccuacggcgccugcccgcgguacgucaagcagaacacccugaagcucgccaccgggaugcgcaacgugcccgagcggcagacgcgcggcaucuucggcgccaucgccggguucaucgagaacggcugggaggggaugguggacggcugguacggguuccggcaccagaacuccgagggcaccggccaggccgccgaccucaagagcacccaggcggccaucgaccagaucaacgggaagcugaaccgccugaucgagaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagacccggaagcagcugcgcgagaacgccgaggacauggggaacggcugcuucaagaucuaccacaagugcgacaacgcgugcaucgggagcauccggaacggcacguacaaccacgacgucuaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggccugccagaaggggaacauccgcugcaacaucugcaucuga

SEQ ID NO: 69493 - RNA, 1701 nt, Artificial Sequence
  derived and/or modified sequence opt1 from hemagglutinin__InfluenzaA__AFG72129
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcuccgggaucagcaucuacuggacgaucgugaagcccggcgacauccugcucaucaacuccaccggcaaccugaucgcgccccgcggguacuucaagauccggaccggcaagagcuccaucaugcgcagcgacgccccgaucgggaccugcuccagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcggcaucuucggggccaucgccggcuucaucgagaacgggugggagggcaugguggacgggugguacggcuuccggcaccagaacagcgagggcaccgggcaggccgccgaccugaaguccacccaggcggccaucaaccagaucaacggcaagcugaaccgccucaucgagaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgcgagaacgccgaggacaugggcaacgggugcuucaagaucuaccacaagugcgacaacgcgugcaucggcuccauccggaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 69494 - RNA, 1701 nt, Artificial Sequence
  derived and/or modified sequence opt1 from hemagglutinin__InfluenzaA__AFG72140
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggcccugggccgcgucaccguguccaccaagcggagccagcagaccgugaucccgaacaucgggagccgccccuggguccggggccuguccagccgcaucuccaucuacuggacgaucgugaagcccggggacauccuccugaucaacagcaccggcaaccugaucgcgccccggggcuacuucaagauccgcaccgggaaguccagcaucaugcgguccgacgccccgaucgggaccugcagcuccgagugcaucacgcccaacggcagcauccccaacaacaagcccuuccagaacgugaaccgcaucaccuacggcgccugcccgcgguacgucaagcagaacacccucaagcuggccaccgggaugcgcaacgugcccgagaagcagacgcggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcucaaccggcugaucgagaagaccaacgagaaguuccaccagaucgagaaggaguucuccgaggucgagggccgcauccaggaccuggagaaguacguggaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 69495 - RNA, 1701 nt, Artificial Sequence
  derived and/or modified sequence opt1 from hemagglutinin__InfluenzaA__AFG72151
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 69496 - RNA, 1701 nt, Artificial Sequence
  derived and/or modified sequence opt1 from hemagglutinin__InfluenzaA__AFG72184
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacgacuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccggcguggcccagagcggggaguccuacgccugcaagcgcggcagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgagcgcgagcagacgucccuguacauccgggccagcggccgcgugaccgucagcaccaagcggucccagcagaccgugaucccgaacaucgggagccgccccugggugcggggccuguccagccgcaucuccaucuacuggacgaucgucaagcccggcgacauccuccugaucaacagcaccgggaaccugaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccugaaguccacccaggcggccaucgaccagaucaacgggaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 69497 - RNA, 1701 nt, Artificial Sequence; identical to SEQ ID NO: 69495
  derived and/or modified sequence opt1 from hemagglutinin__InfluenzaA__AFG72195

SEQ ID NO: 69498 - RNA, 1701 nt, Artificial Sequence
  derived and/or modified sequence opt1 from hemagglutinin__InfluenzaA__AFG72206
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcgacagcccccaccgcauccuggacggcaagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaucaacgaggacuucaacuggaccgggguggcccagagcggcgaguccuacgccugcaagcgggggagcgugaaguccuucuucagccgccucaacuggcugcacgaguccgacuacaaguaccccgcgcugaacgucaccaugcccaacaacggcaaguucgacaagcucuacaucuggggcgugcaccaccccagcaccgaccgggagcagacgucccuguacauccgcgccagcgggcgggugaccgucagcaccaagcgcucccagcagaccgugaucccgaacaucggcagccggcccugggugcgcgggcuguccagccggaucuccaucuacuggacgaucgucaagcccggcgacauccuccugaucaacagcaccgggaaccugaucgcgccccgcggcuacuucaagauccggaccggcaaguccagcaucaugcgcuccgacgccccgaucgggaccugcagcuccgagugcaucacgcccaacggcagcauccccaacgacaagcccuuccagaacgugaaccggaucaccuacggggccugcccgcgcuacgugaagcagaacacccucaagcuggccaccggcaugcggaacguccccgagaagcagacgcgcgggaucuucggcgccaucgccggcuucaucgagaacgggugggagggcaugguggacgggugguacggcuuccggcaccagaacuccgaggggaccggccaggccgccgaccugaaguccacccaggcggccaucgaccagaucaacggcaagcucaaccgccugaucgagaagaccaacgagaaguuccaccagaucgagaaggaguucuccgagguggaggggcggauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgcgagaacgccgaggacaugggcaacgggugcuucaagaucuaccacaagugcgacaacgcgugcaucggcagcauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 69499 - RNA, 1701 nt, Artificial Sequence
  derived and/or modified sequence opt1 from hemagglutinin__InfluenzaA__AFG72217
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccucagcucccggaucagcaucuacuggaccaucgugaagcccggggacauccugcugaucuccagcaccggcaaccucaucgcgccccgcggcuacuucaagauccggaacgggaaguccagcaucaugcgcuccgacgccccgaucggcaacugcagcuccgagugcaucacccccaacgggagcauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgacaucaagagcacccaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcugaaguccggguacaaggaccucauccuguggaucagcuucgccaucagcugcuuccugcucugcgucgugcugcugggcuucaucaugugggccugccagaaggggaacauccgcugcaacaucugcaucuga

SEQ ID NO: 69500 - RNA, 1701 nt, Artificial Sequence
  derived and/or modified sequence opt1 from hemagglutinin__InfluenzaA__AFG72228
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacgaguccgacuacaaguaccccgagcugaacgucaccaugcccaacaacggcaaguucgacaagcucuacaucuggggcgugcaccaccccagcacggaccgcgagcagaccucccuguacgugcgggcgagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggccgcgaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgccugcaucggcagcauccgcaacgggaccuacgaccacgacgucuaccgggacgaggcgcugaacaaccgcuuccagaucaagggcguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 69501 - RNA, 1701 nt, Artificial Sequence
  derived and/or modified sequence opt1 from hemagglutinin__InfluenzaA__AFG72239
augaagaccaucaucgcccugagcuacauccucugccuggugcuggcccagaagcuccccggcuccgacaacagcaccgcgacgcugugccuggggcaccacgccgucccgaacggcacccucgugaagaccaucaccaacgaccagaucgaggugacgaacgccaccgagcugguccaguccagcaccaccgggcgcaucugcgacagcccccaccggauccuggacggcaagaacugcacgcucaucgacgcccugcugggggacccccacugcgacggcuuccagaacaaggagugggaccucuucguggagcgcuccaaggccuacuccaacugcuaccccuacgacgugccggacuacgcgagccugcggucccuggucgccagcuccggcacccucgaguucaccaacgaggacuucaacuggaccgggguggcccagagcggcgaguccuacgccugcaagcgcgggagcgugaaguccuucuucagccggcugaacuggcugcacgaguccgacuacaaguaccccgcgcucaacgucacgaugcccaacaacggcaaguucgacaagcuguacaucuggggcgugcaccaccccagcaccgaccgcgagcagaccucccuguacgugcgggccagcgggcgcgucaccgugagcacgaagcggucccagcagaccgugaucccgaacaucggcagccgccccuggguccgggggcucuccagccgcaucuccaucuacuggaccaucgugaagcccggcgacauccugcugaucaacagcaccgggaaccucaucgcgccccggggcuacuucaagauccgcacgggcaaguccagcaucaugcgguccgacgccccgaucgggaccugcagcuccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagaagacccgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 69502 - RNA, 1701 nt, Artificial Sequence; identical to SEQ ID NO: 69495
  derived and/or modified sequence opt1 from hemagglutinin__InfluenzaA__AFG72272

SEQ ID NO: 69503 - RNA, 1701 nt, Artificial Sequence
  derived and/or modified sequence opt1 from hemagglutinin__InfluenzaA__AFG72316
augaagaccaucaucgcccugagccacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgugccgaucggcaacugcuccagcgagugcaucacccccaacggguccauccccaacgacaagcccuuccagaacgucaaccggaucacguacggcgccugcccgcgcuacgugaagcagaacacccugaagcuggccaccgggaugcggaacgugcccgagaagcagacccgcggcaucuucggcgccaucgccggguucaucgagaacggcugggaggggauggucgacggcugguacggguuccggcaccagaacagcgagggcacgggccaggccgccgaccucaaguccacccaggccgcgaucgaccagaucaacgggaagcugaaccgccugaucgagaagaccaacgagaaguuccaccagaucgagaaggaguucagcgagguggagggccggauccaggaccucgagaaguacguggaggacaccaagaucgaccugugguccuacaacgccgagcugcucgucgcccuggagaaccagcacacgaucgaccugaccgacagcgagaugaacaagcuguucgagaagacccgcaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggcgucgagcucaagagcggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 69504 - RNA, 1701 nt, Artificial Sequence
  derived and/or modified sequence opt1 from hemagglutinin__InfluenzaA__AFG72339
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgucagccuccggucccugguggcgagcuccggcacgcuggaguucaucaacgaggacuucaacuggaccgggguggcccaggacggcgggagcuacacgugcaagcgcggcuccgucaacagcuucuucucccggcucaacuggcugcacaagagcgaguacaaguaccccgcccugaacgugaccaugcccaacaacgggaaguucgacaagcucuacaucuggggcgugcaccaccccuccaccgacagcgaccagaccucccuguacguccgcgccagcggccgggugaccgugagcaccaagcgcucccagcagacggucaccccgaacaucgggagccggcccugggugcgcggccuguccagccggaucuccaucuacuggaccaucgugaagcccggggacauccuccugaucaacagcaccggcaaccugaucgcgccccgcggcuacuucaagauccggaacgggaaguccagcaucaugcgcuccgacgccccgaucggcacgugcagcuccgagugcaucacccccaacgggagcauccccaacgacaagcccuuccagaacgucaaccggaucaccuacggcgccugcccgcgcuacgugaagcagaacacccucaagcuggccacggggaugcggaacgugcccgagaagcagacccgcggcaucuucggcgccaucgcgggguucaucgagaacggcugggaggggauggucgacggcugguacggguuccggcaccagaacuccgagggcaccggccaggccgccgaccugaaguccacccaggccgccaucgaccagaucaacgggaagcucaaccgccugaucgagaagacgaacgagaaguuccaccagaucgagaaggaguucuccgagguggagggccggauccaggaccuggagaaguacguggaggacaccaagaucgaccucuggagcuacaacgcggagcugcuggucgcccucgagaaccagcacaccaucgaccugaccgacuccgagaugaacaagcuguucgagaagacgcgcaagcagcuccgcgagaacgccgaggacauggggaacggcugcuucaagaucuaccacaagugcgacaacgccugcaucgggagcauccggaacggcaccuacgaccacgacguguaccgcgacgaggcccugaacaaccgguuccagaucaagggcgucgagcugaaguccggguacaaggacuggauccucuggaucagcuucgcgaucagcugcuuccugcugugcguggugcuccugggcuucaucaugugggccugccagaaggggaacauccgcugcaacaucugcaucuga

SEQ ID NO: 69505 - RNA, 1701 nt, Artificial Sequence
  derived and/or modified sequence opt1 from hemagglutinin__InfluenzaA__AFG72350
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgucagccuccggucccugguggcgagcuccggcacgcuggaguucaucaacgaggacuucaacuggaccgggguggcccaggacggccgcagcuacgccugcaagcggggguccgucaacagcuucuucucccgccucaacuggcugcacaagagcgaguacaaguaccccgcccugaacgugaccaugcccaacaacggcaaguucgacaagcucuacaucuggggcgugcaccaccccuccaccgacagcgaccagacgucccuguacguccgggcgagcgggcgcgugaccgugagcaccaagcggucccagcagaccgucacgccgaacaucggcagccgccccugggugcgggggcuguccagccgcaucuccaucuacuggaccaucgugaagcccggcgacauccuccugaucaacagcaccgggaaccugaucgcgccccggggcuacuucaagauccgcaacggcaaguccagcaucaugcgguccgacgccccgaucgggaucugcagcuccgagugcaucacccccaacggcagcauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggcuucaucgagaacgggugggagggcauggucgacgggugguacggcuuccgccaccagaacuccgaggggacgggccaggccgccgaccugaaguccacccaggccgcgaucgaccagaucaacggcaagcucaaccggcugaucgagaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagaagacccgcaagcagcuccgggagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggcuacaaggacuggauccucuggaucagcuucgccaucagcugcuuccugcugugcguggugcuccugggguucaucaugugggccugccagaagggcaacauccggugcaacaucugcaucuga

SEQ ID NO: 69506 - RNA, 1701 nt, Artificial Sequence
  derived and/or modified sequence opt1 from hemagglutinin__InfluenzaA__AFG72372
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacacgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccaccccagcaccgacuccgaccagaccagccuguacgugcgcgcguccgggcgggucaccgugagcaccaagcgcagccagcagacggugaucccgaacaucggcucccggcccuggguccgcgggcucagcucccggaucagcaucuacuggaccaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucacguacggggccugcccgcgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggacgggccaggccgccgaccucaaguccacccaggccgcgaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacacgaucgaccugaccgacagcgagaugaacaagcuguucgagcgcacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcgcugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 69507 - RNA, 1701 nt, Artificial Sequence; identical to SEQ ID NO: 62032
  derived and/or modified sequence opt1 from hemagglutinin__InfluenzaA__AFG72383

SEQ ID NO: 69508 - RNA, 1701 nt, Artificial Sequence
  derived and/or modified sequence opt1 from hemagglutinin__InfluenzaA__AFG72394
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccguggccaccaagcgcagccagcagaccgugaucccgaacaucggcuuccggcccuggguccgcgggcagagcuccggcaucagcaucuacuggacgaucgugaagcccggggacauccuccugaucaacuccaccggcaaccugaucgcgccccggggcuacuucaagauccgcaacgggaaguccuccaucaugcggagcgacgccccgaucggcaacugcuccagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgcggaccugaaguccacgcaggccgccaucgaccagaucaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgggcugcugguggcccucgagaaccagcacaccaucgaccugacggacagcgagaugaacaagcuguucgagcggacccgcaagcagcuccgcgagaacgcggaggacaugggcaacgggugcuucaagaucuaccacaagugcgacaacgccugcaucggcuccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 69509 - RNA, 1701 nt, Artificial Sequence
  derived and/or modified sequence opt1 from hemagglutinin__InfluenzaA__AFG72405
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccaggacggcgggagcuacgccugcaagcgcggcuccgugaaguccuucuucucccggcucaacuggcugcacaagcuggaguacaaguaccccgcgcucaacgucaccaugcccaacaacgggaaguucgacaagcuguacaucuggggcgugcaccaccccagcacggacuccgaccagaccagccuguacgugcgcgccuccggccgggucaccgugagcaccaagcgcagccagcagacggugaccccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacggcaagagcuccaucaugcgcagcgacgccccgaucgggacgugcuccagcgagugcaucacccccaacggguccauccccaacgacaagcccuuccagaacgugaaccggaucaccuacggcgccugcccgcgcuacgucaagcagaacacccugaagcuggccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacccaggcggccaucaaccagaucaacgggaagcugaaccgccugaucgagaagacgaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugaccgacagcgagaugaacaagcuguucgagaagacgcgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 69510 - RNA, 1701 nt, Artificial Sequence
  derived and/or modified sequence opt1 from hemagglutinin__InfluenzaA__AFG72449
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcuacagcccccaccggauccuggacggcaacaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaagggcuucuucagccggcucaacuggcugcacaagcuggaguacaaguaccccgcgcucaacgucaccaugcccaacaacgggaaguucgacaagcuguacaucuggggcgugcaccaccccuccaccgacagcgaccagacgucccuguacgugcgcgccagcggcggggucaccguguccaccaagcggagccagcagaccgugaucccgagcaucggcucccgccccuggguccgggggcucagcucccgcaucagcaucuacuggacgaucgugaagcccggcgacauccugcugaucaacuccaccggcaaccucaucgcgccccggggguacuucaagauccgcaacggcaagagcuccaucaugcggagcgacgccccgaucgggaacugcuccagcgagugcaucacccccaacggcuccauccccaacgacaagcccuuccagaacgugaaccgcaucaccuacggggccugcccgcgguacgucaagcagaacacgcugaagcuggccaccggcaugcgcaacgugcccgagaagcagacccggggcaucuucggggccaucgccggcuucaucgagaacgggugggagggcaugguggacgggugguacggcuuccgccaccagaacagcgagggcaccgggcaggccgccgaccucaaguccacgcaggcggccaucgaccagaucaacggcaagcugaaccggcugaucgagaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugacggacagcgagaugaacaagcuguucgagcggacccgcaagcagcuccgcgagaacgccgaggacaugggcaacgggugcuucaagaucuaccacaagugcgacaacgcgugcaucggcuccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 69511 - RNA, 1701 nt, Artificial Sequence; identical to SEQ ID NO: 62061
  derived and/or modified sequence opt1 from hemagglutinin__InfluenzaA__AFG72460

SEQ ID NO: 69512 - RNA, 1701 nt, Artificial Sequence
  derived and/or modified sequence opt1 from hemagglutinin__InfluenzaA__AFG72504
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaaguccuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucauccgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 69513 - RNA, 1701 nt, Artificial Sequence
  derived and/or modified sequence opt1 from hemagglutinin__InfluenzaA__AFG72515
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaucaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccaccgacagcgaccagacgucccuguacgugcgcgccagcgggcgggucaccguguccaccaagcgcagccagcagaccgugauccccgacaucggcuaccggcccuggguccgcgggcucagcucccggaucagcaucuacuggacgaucgugaagcccggcgacauccugcugaucaacuccaccgggaaccucaucgccccgcgcggcuacuucaagauccggaacggcaagagcuccaucaugcgcagcgacgcccccaucgggaacugcuccagcgagugcaucacccccaacggcuccauccccaacgacaagccguuccagaacgugaaccggaucaccuacggggccugcccccgcuacgucaagcagaacacgcugaagcuggcgaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccuggucgagaagaccaacgagaaguuccaccagaucgagaaggaguucagcgagguggaggggcggauccaggaccucgagaaguacguggaggacaccaagaucgaccugugguccuacaacgccgagcugcucgucgcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggugcugcugggguucaucaugugggccugccagaagggcaacauccggugcaacaucugcaucuga

SEQ ID NO: 69514 - RNA, 1701 nt, Artificial Sequence
  derived and/or modified sequence opt1 from hemagglutinin__InfluenzaA__AFG72526
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccagcugcuaccccuacgacgugccggacuacgcgucccuccggagccuggucgccuccagcggcacgcuggaguucaucaacgaggacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccaccccuccaccgacagcgaccagacgucccuguacgugcgcgccagcgggcgggucaucgugagcaccaagcgcucccagcagaccgugaucccgaacaucggcagccggcccuggguccgcgggcucuccagccggaucuccaucuacuggaccaucgugaagcccggcgacauccugcugaucaacagcacggggaaccucaucgcgccccgcggcuacuucaagauccggaccggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcagaccgcgaucaaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagcgcacccgcaagcagcuccgggagaacgccgaggacaugggcaacgggugcuucaagaucuaccacaagugcgacaacgccugcaucggcagcauccgcaacgggaccuacgaccacgacgucuaccgggacgaggcgcugaacaaccgcuuccagaucaagggcguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 69515 - RNA, 1701 nt, Artificial Sequence
  derived and/or modified sequence opt1 from hemagglutinin__InfluenzaA__AFG72581
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggggcgucaccgugagcaccaagcggagccagcagaccgugaucccgaacaucggguaccgccccuggguccggggccucuccagccgcaucuccaucuacuggacgaucgugaagcccggggacauccugcugaucaacagcaccggcaaccucaucgcgccccggggcuacuucaagauccgcaacgggaaguccagcaucaugcgguccgacgccccgaucggcaacugcagcuccgagugcaucacccccaacgggagcaucuccaacgacaagcccuuccagaacgugaaccgcaucaccuacggcgccugcccccgguacgucaagcagaacacgcugaagcuggccaccgggaugcgcaacgugccggagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 69516 - RNA, 1701 nt, Artificial Sequence
  derived and/or modified sequence opt1 from hemagglutinin__InfluenzaA__AFG72603
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgggaacugcaaguccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaccgaccagaucaacggcaagcugaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggacguacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 69517 - RNA, 1701 nt, Artificial Sequence
  derived and/or modified sequence opt1 from hemagglutinin__InfluenzaA__AFG72614
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacuccugcaagcgcggcagcgugaaguccuucuucagccggcucaacuggcugcacaagcuggaguacaaguaccccgcccucaacgucgcgaugcccaacaacgacaaguucgacaagcuguacaucuggggcgugcaccaccccuccacggacagcgaccagaccucccuguacgugcaggccagcgggcgcgucaccgugagcaccaagcggucccagcagacggugaucccgaacaucggcagccgccccuggguccgcgggguguccagccggaucuccaucuacuggaccaucgugaagcccggcgacauccuccugaucaacagcaccgggaaccugaucgcgccccggggcuacuucaagauccgcuccggcaagagcuccaucaugcggagcgacgccccgaucgggaacugcaacuccgagugcaucacccccaacggcagcauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggcuucaucgagaacgggugggagggcauggucgacgggugguacggcuuccgccaccagaacuccgaggggacgggccaggccgccgaccugaaguccacccaggcggccaucaaccagaucaacggcaagcucaaccggcugaucgagaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 69518 - RNA, 1701 nt, Artificial Sequence
  derived and/or modified sequence opt1 from hemagglutinin__InfluenzaA__AFG72625
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgggggaucagcucccgcaucagcaucuacuggaccaucgugaagcccggcgacauccuccugaucaaguccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacgucuaccgcgacgaggcccugaacaaccgguuccagaucaagggcguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 69519 - RNA, 1701 nt, Artificial Sequence
  derived and/or modified sequence opt1 from hemagglutinin__InfluenzaA__AFG72636
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgucaagagcuucuucucccggcucaacuggcugcacaagcuggaguucaaguaccccgcgcucaacgugaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 69520 - RNA, 1701 nt, Artificial Sequence
  derived and/or modified sequence opt1 from hemagglutinin__InfluenzaA__AFG72658
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccggauccuggacggcaagaacugcacccugaucgacgcccuccugggggacccccacugcgacggcuuccagaacaaggagugggaccuguucgucgagcgcagcaaggcguacuccaacugcuaccccuacgacgugccggacuacgccagccuccggucccugguggccagcuccggcacgcuggaguucaccaacgagggguucaacuggaccggcgucgcccaggacgggaaguccuacgcgugcaagcgcggcuccgugaacagcuucuucucccggcucaacuggcugcacaagcuggaguacaaguaccccgcccucaacgugaccaugcccaacaacgacaaguucgacaagcuguacaucuggggcguccaccaccccagcacggacuccgaccagaccagccuguacgugcaggccuccgggcgcgugaccgucagcaccaagcggagccagcagacggugaucccgaacaucggcucccgccccugggugcgggggaucagcucccgcaucagcaucuacuggaccaucgucaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacggcugggaggggaugguggacggcugguacggguuccgccaccagaacuccgagggcacggggcaggccgcggaccucaagagcacccaggccgccaucgaccagaucaacggcaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacauggggaacggcugcuucaagaucuaccacaagugcgacaacgccugcaucgggagcauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 69521 - RNA, 1701 nt, Artificial Sequence
  derived and/or modified sequence opt1 from hemagglutinin__InfluenzaA__AFG72680
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaucaucugcgacagcccccaccgcauccuggacggcaagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaccaacgagggguucaacuggaccggcguggcccaggacgggaccagcuacgccugcaagcggggcuccgugaaguccuucuucucccgccucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgggucaccgugagcacgcgccggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaaccggaagcucaaccgccugaucgagaagaccaacgagaaguuccaccagaucgagaaggaguucagcgagguggagggccggauccaggaccuggagaaguacguggaggacacgaagaucgaccucugguccuacaacgccgagcugcuggucgcccucgagaaccagcacaccaucgaccugaccgacagcgagaugaacaagcuguucgagcgcacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 69522 - RNA, 1701 nt, Artificial Sequence
  derived and/or modified sequence opt1 from hemagglutinin__InfluenzaA__AFG72691
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuucaagaacaaggagugggaccuguucguggagcgcagcacggccuacuccaacugcuaccccuacgacgugccggacuacgcgagccuccggucccuggucgccagcuccggcacccuggaguucaccaacgagggguucaacuggaccggcguggcccaggacgggacgagcuacgccugcaagcgcggcuccgugaaguccuucuucucccggcucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgcgucacggugagcaccaagcggagccagcagaccgugaucccgaacaucggcucccgccccuggguccgcggggugagcucccggaucagcaucuacuggaccaucgugaagcccggcgacauccuccugaucaacuccacggggaaccugaucgcgccccggggcuacuucaagauccgcagcggcaaguccagcaucaugcgguccgacgccccgaucgacaacugcaacagcgagugcaucacccccaacggguccauccccaacggcaagcccuuccagaacgucaaccgcaucaccuacggggccugcccgcgguacgugaagcagaacacccucaagcuggccacgggcaugcgcaacgugcccgagaagcagacccgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagacgaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacaccaucgaccugaccgacagcgagaugaacaagcuguucgagcggacgcgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagagcggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 69523 - RNA, 1701 nt, Artificial Sequence
  derived and/or modified sequence opt1 from hemagglutinin__InfluenzaA__AFG72713
augaagaucaucaucgcccugagcuacauccucugccugguguucgcccagaagcugcccggcaacgacaacuccaccgcgacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcaagaacugcacccugaucgacgcccuccugggggacccccacugcgacggcuucaagaacaaggagugggaccuguucguggagcggagcaccgccuacuccaacugcuaccccuacgacgugccggacuacgcgagccuccgcucccuggucgccagcuccggcacgcuggaguucaccaacgagggguucaacuggaccggcguggcccaggacgggaccagcuacgccugcaagcggggcuccgugaaguccuucuucucccgccucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgggucaccgugagcacgaagcgcagccagcagaccgugaucccgaacaucggcucccggcccuggguccgcgggaucagcucccggaucagcaucuacuggaccaucgugaagcccggcgacauccuccugaucuccagcaccgggaaccugaucgcgccccgcggcuacuucaagauccgguccggcaagagcuccaucauccgcagcgacgccccgaucgacaacugcaacuccgagugcaucacgcccaacgggagcauccccaacgacaagcccuuccagaacgugaaccggaucaccuacggcgccugcccgcgcuacgucaagcagaacacccucaagcuggccaccgggaugcggaacgugcccgagaagcagacgcgcggcaucuucggggccaucgccggcuucaucgagaacggcugggaggggaugguggacggcugguacggguuccggcaccagaacuccgagggcaccgggcaggccgccgaccucaagagcacccaggcggccaucaaccagaucaacggcaagcugaaccgccugaucgagaagaccaacgagaaguuccaccagaucgagaaggaguucuccgaggucgagggccggauccaggaccuggagaaguacguggaggacacgaagaucgaccucuggagcuacaacgccgagcugcugguggcccucgagaaccagcacaccaucgaccugaccgacuccgagaugaacaagcuguucgagcgcacccggaagcagcuccgcgagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggcuucaucaugugggccugccagaaggggaacauccggugcaacaucugcaucuga

SEQ ID NO: 69524 - RNA, 1701 nt, Artificial Sequence
  derived and/or modified sequence opt1 from hemagglutinin__InfluenzaA__AFG72724
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgacaacugcaacagcgagugcaucacgcccaacggguccauccccaacgacaagcccuuccagaacgucaaccgcaucaccuacggcgccugcccgcgguacgugaagcagaacacccucaagcuggccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcucaaccggcugaucgagaagaccaacgagaaguuccaccagaucgagaaggaguucagcgagguggagggccgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacauggggaacggcugcuucaagaucuaccacaagugcgacaacgugugcaucggguccauccggaacggcacguacgaccacgacgucuaccgcgacgaggcgcugaacaaccgguuccagaucaaggggguggagcucaagagcggcuacaaggacuggauccuguggaucuccuucgccaucagcugcuuccugcugugcgugguccuccugggcuucaucaugugggccugccagaaggggaacauccgcugcaacaucugcaucuga

SEQ ID NO: 69525 - RNA, 1701 nt, Artificial Sequence
  derived and/or modified sequence opt1 from hemagglutinin__InfluenzaA__AFG72735
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuucaagaacaaggagugggaccuguucguggagcgcagcacggccuacuccaacugcuaccccuacgacgugccggacuacgcgagccuccggucccuggucgccagcuccggcacccuggaguucaccaacgagggguucaacuggaccggcguggcccaggacgggacgagcuacgccugcaagcgcggcuccgugaaguccuucuucucccggcucaacuggcugcacaagcuggaguacaaguaccccgcgcucaccgucaccaugcccaacaacgacaaguucgacaagcuguacaucuggggcgugcaccaccccagcaccgacuccgaccagacgagcaucuacgugcaggccuccgggcgcgucaccgugagcaccaagcggagccagcagaccgugaucccgaacaucggcucccgccccuggguccgcggggugagcucccggaucagcaucuacuggacgaucgugaagcccggcgacauccugcucaucaacuccaccgggaaccugaucgcgccccggggcuacuucaagauccgcagcggcaaguccagcaucaugcgguccgacgccccgaucgacaacugcaacagcgagugcaucacccccaacggguccauccccaacgacaagcccuuccagaacgucaaccgcaucaccuacggcgccugcccgcgguacgugaagcagaacacgcugaagcucgccaccgggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacgcaggcggccaucaaccagaucaacggcaagcugaaccggcucaucgagaagaccaacgagaaguuccaccagaucgagaaggaguucagcgagguggagggccgcauccaggaccuggagaaguacguggaggacaccaagaucgacaucugguccuacaacgccgagcugcucgucgcccuggagaaccagcacaccaucgaccugacggacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggugcugcugggcuucaucaugugggccugccagaaggggaacauccgcugcaacaucugcaucuga

SEQ ID NO: 69526 - RNA, 1701 nt, Artificial Sequence
  derived and/or modified sequence opt1 from hemagglutinin__InfluenzaA__AFG72757
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcuccaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgcagcuccaucaagagcuucuucucccggcugaacuggcuccaccagcugaaguacaaguaccccgcgcugaacgugaccaugcccaacaacgacaaguucgacaagcucuacaucuggggcguccaccaccccagcacggacuccgaccagaccagcaucuacgcccaggccagcgggcgcgugaccguguccaccaagcggagccagcagacggucaucccgaacaucgggucccgccccugggugcggggcaucagcucccgcaucagcauccacuggaccaucgugaagcccggcgacauccugcugaucaacuccaccgggaaccucaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucacguacggggccugcccgcgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacagcgaggggacgggccaggccgcggaccucaaguccacccaggccgccaucaaccagaucaacgggaagcugaaccggcugaucgagaagaccaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcguggagcucaagagcggguacaaggacuggauccuguggaucagcuucgccaucuccugcuuccugcucugcgucgugcugcugggcuucaucaugugggccugccagaagggcaacauccgcugcaacaucugcaucuga

SEQ ID NO: 69527 - RNA, 1701 nt, Artificial Sequence
  derived and/or modified sequence opt1 from hemagglutinin__InfluenzaA__AFG72779
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccacccgccggagccagcagacggucaucccgaacaucgggucccgccccugggugcggggcgugagcuccggcaucagcaucuacuggaccaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacggcugggaggggaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 69528 - RNA, 1701 nt, Artificial Sequence
  derived and/or modified sequence opt1 from hemagglutinin__InfluenzaA__AFG72801
augaagaccaucaucgcccugagcuacauccucugccugguguucgcccagaagcugcccggcaacgacaacuccaccgcgacgcucugccuggggcaccacgccgucagcaacggcacccuggugaagaccaucaccaacgaccagaucgaggugacgaacgccaccgagcucguccaguccagcuccaccgggcgcaucugcgacagcccgcaccagauccuggacggcgagaacugcacccugaucgacgcccuccugggggacccccacugcgacggcuuccagaacaaggagugggaccuguucguggagcgguccaaggccuacagcaacugcuaccccuacgacgugcccgacuacgcgucccuccgcagccuggucgccuccagcggcacgcuggaguucaacaacgaguccuucaacuggaccgggguggcccagaacggcaccagcuccgccugcaagcggcgcagcaacaaguccuucuucagccggcucaacuggcugcaccagcugaaguacaaguacccggcgcucaacgugaccaugcccaacaacgagaaguucgacaagcuguacaucuggggcguccaccaccccuccacggacagcgaccagaucagcaucuacgcccaguccagcgggcgcgugaccguguccaccaagcggagccagcagaccgucauccccaacaucggguccagcccgugggugcgcggcguguccagccggaucuccaucuacuggacgaucgucaagcccggcgacauccugcucaucaacagcaccgggaaccugaucgcgccccgcggcuacuucaagauccgguccggcaagagcuccaucaugcgcagcgacgcccccaucgggaagugcaacuccgagugcaucaccccgaacggcagcauccccaacgacaagcccuuccagaacgugaaccggaucaccuacggggccugcccccgcuacgugaagcagaacacgcugaagcucgccaccggcaugcggaacgucccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggcggccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacagcgagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcucaagagcggguacaaggacuggauccuguggaucuccuucgccaucagcugcuuccugcugugcgugguccugcucggcuucaucaugugggccugccagaagggcaacauccgcugcaacaucugcaucuga

SEQ ID NO: 69529 - RNA, 1701 nt, Artificial Sequence
  derived and/or modified sequence opt1 from hemagglutinin__InfluenzaA__AFG72812
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccugaacuccgagggcaccgggcaggccgccgaccucaagagcacgcaggcggccaucaaccagaucaacggcaagcugaaccggcugaucgagaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcucaaguccggcuacaaggacuggauccuguggaucagcuucgccaucagcugcuuccugcucugcaucgugcugcugggcuucaucaugugggccugccagaaggggaacauccggugcaacaucugcaucuga

SEQ ID NO: 69530 - RNA, 1701 nt, Artificial Sequence
  derived and/or modified sequence opt1 from hemagglutinin__InfluenzaA__AFG72823
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccugcaccccgggaccgacagcgaccagaucucccuguacgcgcaggccagcggccggaucaccgugagcacgaagcgcucccagcagaccgugaucccgaacaucggcagccggccccgcguccgcgggguguccagccggaucuccaucuacuggaccaucgugaagcccggcgacauccuccugaucaacagcaccgggaaccugaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgucaaccgcaucaccuacggggccugcccgcgguacaucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacuccgaggggaccggccaggccgccgaccugaaguccacccaggcggccaucaaccagaucaacggcaagcucaaccggcugaucgggaagaccaacgagaaguuccaccagaucgagaaggaguucuccgaggucgagggccgcauccaggaccuggagaaguacguggaggacacgaagaucgaccucuggagcuacaacgccgagcugcugguggcccucgagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaagggcguggagcugaaguccggguacaaggacuggauccucuggaucagcuucgccaucagcugcuuccugcugugcguggcccuccugggcuucaucaugugggccugccagaaggggaacauccggugcaacaucugcaucuga

SEQ ID NO: 69531 - RNA, 1701 nt, Artificial Sequence
  derived and/or modified sequence opt1 from hemagglutinin__InfluenzaA__AFG72834
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccaguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 69532 - RNA, 1701 nt, Artificial Sequence
  derived and/or modified sequence opt1 from hemagglutinin__InfluenzaA__AFG72845
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugcgcuacaaguaccccgcccucaacgucaccaugcccaacaacgagaaguucgacaagcuguacaucuggggcgugcaccaccccgggacggacuccgaccagaucagccuguacgcgcaggccagcggccgggugaccaucuccaccaagcgcagccagcagaccgucaucccgaacaucgggucccggcccugggugcgcggcgugagcucccggaucagcauccacuggacgaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaagacgcucaagcuggccaccggcaugcggaacguccccgagaagcagacccgcgggaucuucggcgccaucgccggguucaucgagaacggcugggagggcaugauggacgggugguacggcuuccggcaccagaacagcgaggggaccggccaggccgccgaccugaaguccacgcaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugacggacagcgagaugaacaagcuguucgagcgcaccaagaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcguggagcucaagagcggguacaaggacuggauccuguggaucagcuucgccaucuccugcuuccugcugugcaucguccuccugggcuucaucaugugggccugccagaagggcaacauccgcugcaacaucugcaucuga

SEQ ID NO: 69533 - RNA, 1701 nt, Artificial Sequence
  derived and/or modified sequence opt1 from hemagglutinin__InfluenzaA__AFG72856
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaccaacgagagcuucaacuggaccggcgucacccagaacgggacguccagcgccugcaagcgccgguccaacaagagcuucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccagcggccggaucacggucagcaccaagcgcucccagcagaccgugaucccgaacaucggcagccggccccgcgugcgggacaucuccagccgcaucuccaucuacuggaccaucgucaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgugaagcagaacacccugaagcucgccacggggaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaacaagcucaucggcaagacgaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacaccaucgaccucaccgacuccgagaugaacaagcuguucgagcgcacgaagaagcagcugcgggagaacgccgaggacaugggcaacgggugcuucaagaucuaccacaagugcgacaacgcgugcaucggcagcauccgcaacgggaccuacgaccacgacguguaccgcgacgaggcccucaacaaccgguuccagaucaagggcgucgagcugaaguccggcuacaaggacuggauccuguggaucagcuucgccaucagcugcuuccuccugugcguggugcugcucggguucaucaugugggccugccagaagggcaacauccgcugcaacaucugcaucuga

SEQ ID NO: 69534 - RNA, 1701 nt, Artificial Sequence
  derived and/or modified sequence opt1 from hemagglutinin__InfluenzaA__AFG72867
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccaacaagagcuucuucucccggcucaacuggcugcaccagcugaagaacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgcccccgggugcgcgacaucuccagccggaucuccaucuacuggacgaucgucaagcccggcgacauccuccugaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugauggacgggugguacggcuuccggcaccagaacuccgaggggaccggccaggccgccgaccucaagagcacgcaggcggccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugacggacuccgagaugaacaagcuguucgagcgcaccaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcguggagcugaaguccggguacaaggacuggauccucuggaucagcuucgccaucagcugcuuccugcugugcaucguccuccugggcuucaucaugugggccugccagaagggcaacauccgcugcaacaucugcaucuga

SEQ ID NO: 69535 - RNA, 1701 nt, Artificial Sequence
  derived and/or modified sequence opt1 from hemagglutinin__InfluenzaA__AFG72922
augaagaccaucaucgcccugagcuacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcauccgcaagagcaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcccaggcguccgggcgcaucaccgugagcacgaagcggagccagcagaccgugaucccgaacaucggcucccgcccccggguccgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcucgccaccggcaugcggaacgugcccgagaagcagacgcgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 69536 - RNA, 1701 nt, Artificial Sequence
  derived and/or modified sequence opt1 from hemagglutinin__InfluenzaA__AFG72933
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcgugcgccgguccaacaacagcuucuucucccgccugaacuggcucacgcaccugaaguucaaguaccccgcccugaacgucaccaugcccaacaacgagcaguucgacaagcucuacaucuggggcgugcaccaccccgggaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 69537 - RNA, 1701 nt, Artificial Sequence
  derived and/or modified sequence opt1 from hemagglutinin__InfluenzaA__AFG72955
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccuccgguucaaguaccccgcccugaacgugaccaugcccaacaacgagcaguucgacaagcuguacaucuggggcgugcaccaccccgggaccgacaacgaccagaucuuccuguacgcgcaggccagcgggcgcaucaccgucuccacgaagcggagccagcagaccgugaucccgaacaucggcagccgcccccgggugcgcaacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69538 - RNA, 1701 nt, Artificial Sequence; identical to SEQ ID NO: 62648
  derived and/or modified sequence opt1 from hemagglutinin__InfluenzaA__AFG98808

SEQ ID NO: 69539 - RNA, 1701 nt, Artificial Sequence; identical to SEQ ID NO: 62648
  derived and/or modified sequence opt1 from hemagglutinin__InfluenzaA__AFG98819

SEQ ID NO: 69540 - RNA, 1701 nt, Artificial Sequence
  derived and/or modified sequence opt1 from hemagglutinin__InfluenzaA__AFG98830
augaagaccaucaucgcccugagcuacaucuucugccucgugcugggccaggaccugcccgggaacgacaaguccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaccgagggcuucaccuggacgggggugacccagaacggcggguccagcgccugcaagcggggccccggcuccggguucuucagccgccucaacuggcugaccaaguccggcagcaccuaccccgugcugaacgucacgaugcccaacaacgacaacuucgacaagcucuacaucuggggcgugcaccacccguccaccaaccaggagcagaccagccuguacgugcaggccuccgggcgggucaccgugagcacgcgccggagccagcagaccaucauccccaacaucggcucccgccccugggugcgggggcugagcucccgcaucagcaucuacuggaccaucgucaagcccggcgacauccucaucaucaacuccaacgggaaccugaucgccccgcggggcuacuucaagaugcgcaccggcaagagcuccaucaugcggagcgacgcgcccaucgacacgugcaucuccgagugcaucacccccaacgggagcauccccaacgacaagccguuccagaacgugaacaagaucaccuacggcgccugccccaaguacgugaagcagaacacccugaagcucgccacggggaugcgcaacguccccgagaagcagacccggggccuguucggggccaucgccggcuucaucgagaacgggugggagggcaugaucgacggcugguacggguuccgccaccagaacuccgagggcaccgggcaggcggccgaccucaagagcacccaggccgccaucgaccagaucaacggcaagcugaaccgggugaucgagaagacgaacgagaaguuccaccagaucgagaaggaguucuccgagguggaggggcgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgcggcgccagcugcgggagaacgccgaggacaugggcaacggcugcuucaagaucuaccacaagugcgacaacgccugcaucgggagcauccgcaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggcgugccagaaggggaacauccgcugcaacaucugcaucuga

SEQ ID NO: 69541 - RNA, 1701 nt, Artificial Sequence
  derived and/or modified sequence opt1 from hemagglutinin__InfluenzaA__AFG98841
augaagaccaucaucgcccugagcuacaucuucugccucgugcugggccaggaccugcccgggaacgacaaguccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaccgagggcuucaccuggacgggggugacccagaacggcggguccaacgccugcaagcggggccccggcagcggguucuucucccgccucaacuggcugaccaagagcggcuccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcgggggcuguccagccgcaucuccaucuacuggaccaucgucaagcccggcgacauccucaucaucaacagcaacgggaaccugaucgccccgcggggcuacuucaagaugcgcaccgggaaguccagcaucaugcgguccgacgcgcccaucggcacgugcaucagcgagugcaucacccccaacggcuccauccccaacgacaagccguuccagaacgugaacaagaucaccuacggggccugccccaaguacgugaagcagaacacccugaagcucgccacgggcaugcgcaacguccccgagaagcagacccgggggcuguucggcgccaucgccggguucaucgagaacggcugggagggcaugaucgacgggugguacggcuuccgccaccagaacagcgaggggaccggccaggcggccgaccugaaguccacccaggccgccaucgaccagaucaacgggaagcucaaccgggugaucgagaagacgaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcgugguccugcucggguucaucaugugggcgugccagaagggcaacauccgcugcaacaucugcaucuga

SEQ ID NO: 69542 - RNA, 1701 nt, Artificial Sequence; identical to SEQ ID NO: 61313
  derived and/or modified sequence opt1 from hemagglutinin__InfluenzaA__AFG98852

SEQ ID NO: 69543 - RNA, 1701 nt, Artificial Sequence
  derived and/or modified sequence opt1 from hemagglutinin__InfluenzaA__AFG98863
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaacgagggcuucaccuggaccggggugacgcagaacggcggguccagcgccugcaagcggggccccgacuccggcuucuucagccgccucaacuggcuguacaaguccgggagcaccuaccccgugcugaacgucaccaugcccaacaacgacaacuucgacaagcucuacaucuggggcgugcaccacccguccaccaaccaggagcagacgagccuguacgugcaggccuccgggcgggucaccgugagcaccaagcgcagccagcagaccaucauccccaacaucggcucccggcccugggugcgcggccugagcucccggaucagcaucuacuggacgaucgucaagcccggggacauccucgugaucaacuccaacggcaaccugaucgccccgcgcggguacuucaagaugcggaccggcaagagcuccaucaugcgcagcgacgcgcccaucgggaccugcaucuccgagugcaucacccccaacggcagcauccccaacgacaagccguuccagaacgugaacaagaucacguacggcgccugccccaaguacgucaagcagaacacccugaagcucgccaccgggaugcggaacgugcccgagaagcagacccgcggccuguucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccuggagaaguacguggaggacaccaagaucgaccuguggagcuacaacgccgagcuccugguggcgcuggagaaccagcacacgaucgaccucaccgacuccgagaugaacaagcuguucgagaagacccgccggcagcugcgcgagaacgccgaggacaugggcaacggcugcuuccggaucuaccacaagugcgacaacgccugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggcgugccagaaggggaacauccgcugcaacaucugcaucuga

SEQ ID NO: 69544 - RNA, 1701 nt, Artificial Sequence
  derived and/or modified sequence opt1 from hemagglutinin__InfluenzaA__AFG98874
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacaacggcuucuucagccgccugaacuggcucuacaaguccgggagcaccuaccccgugcugaacgucaccaugcccaacaacgacaacuucgacaagcuguacaucuggggcgugcaccacccguccaccgaccaggagcagacgagccucuacgugcaggccuccgggcgggucaccgugagcaccaagcgcucccagcagaccaucauccccaacaucggcagccggcccugggugcgcggccugagcucccggaucagcaucuacuggacgaucgucaagcccggggacauccuggugaucaacuccaacggcaaccucaucgccccgcgcggguacuucaagaugcggaccggcaagagcuccaucaugcgcagcgacgcgcccaucgggaccugcaucuccgagugcaucacccccaacggcagcauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccucgagaaguacguggaggacaccaagaucgaccuguggagcuacaacgccgagcugcucguggcgcuggagaaccagcacacgaucgaccugaccgacuccgagaugaacaagcuguucgagaagacccgccggcagcugcgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcgucgugcugcugggcuucaucaugugggcgugccagaaggggaacauccggugcaacaucugcaucuga

SEQ ID NO: 69545 - RNA, 1701 nt, Artificial Sequence
  derived and/or modified sequence opt1 from hemagglutinin__InfluenzaA__AFG98885
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggcaccgacagcggcuucuucucccgccugaacuggcucuacaagagcggguccaccuaccccgugcugaacgucaccaugcccaacaacgacaacuucgacaagcuguacaucuggggcgugcaccaccccagcacggaccaggagcagaccucccucuacgugcaggccagcgggcgggucaccguguccaccaagcgcagccagcagacgaucaucccgaacaucggcagccggcccugggugcgcggccuguccagccggaucuccaucuacuggaccaucgucaagcccggggacauccuggugaucaacagcaacggcaaccucaucgcgccccgcggguacuucaagaugcggaccggcaaguccagcaucaugcgcuccgacgccccgaucgggaccugcaucagcgagugcaucacgcccaacggcuccauccccaacgacaagcccuuccagaacgugaacaagaucaccuacggcgccugcccgaaguacgucaagcagaacacccugaagcuggccaccgggaugcggaacgugcccgagaagcagacgcgcggccucuucggggccaucgccggcuucaucgagaacgggugggagggcaugaucgacggcugguacggguuccggcaccagaacagcgagggcaccgggcaggcggccgaccugaaguccacccaggccgccaucgaccagaucaacggcaagcugaaccgcgugaucgagaagaccaacgagaaguuccaccagaucgagaaggaguucagcgaggucgaggggcggauccaggaccucgagaaguacguggaggacacgaagaucgaccugugguccuacaacgccgagcugcucguggcgcuggagaaccagcacaccaucgaccugaccgacagcgagaugaacaagcuguucgagaagacccgccggcagcuccgcgagaacgccgaggacaugggcaacggcugcuucaagaucuaccacaagugcgacaacgccugcaucggguccauccggaacggcacguacgaccacgacgucuaccgcgacgaggcccugaacaaccgcuuccagaucaaggggguggagcucaagagcggcuacaaggacuggauccuguggaucuccuucgccaucagcugcuuccugcucugcgucgugcugcugggcuucaucaugugggcgugccagaaggggaacauccggugcaacaucugcaucuga

SEQ ID NO: 69546 - RNA, 1701 nt, Artificial Sequence
  derived and/or modified sequence opt1 from hemagglutinin__InfluenzaA__AFG98896
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucaacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacagcggcuucuucucccgccugaacuggcucuacaagagcggguccgccuaccccgugcugaacgucaccaugcccaacaacgacaacuucgacaagcuguacaucuggggcgugcaccacccgagcaccgaccaggagcagaccaaccucuacgugcagacguccgggcgggucaccgugagcaccaagcgcucccagcagaccaucauccccaacaucggcagccggcccugggugcgcggccugagcucccggaucagcaucuacuggacgaucgucaagcccggggacauccuggugaucaacuccaacggcaaccucaucgccccgcgcggguacuucaagaugcggaccggcaagagcuccaucaugcgcagcgacgcgcccaucgggaccugcaucuccgagugcaucacccccaacggcagcauccccaacgacaagccguuccagaacgugaacaagaucacguacggcgccugccccaaguacgucaagcagaacacccugaagcuggccaccgggaugcggaacgugcccgagaagcagacccgcggcaucuucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcgcucgagaaccagcacacgaucgaccugaccgacuccgagaugaacaagcuguucgagaagacccgccggcagcuccgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcugaaguccggcuacaaggacuggauccucuggaucagcuucgccaucuccugcuuccugcugugcgucgugcuccugggcuucaucaugugggcgugccagaaggggaacauccggugcaacaucugcaucuga

SEQ ID NO: 69547 - RNA, 1701 nt, Artificial Sequence
  derived and/or modified sequence opt1 from hemagglutinin__InfluenzaA__AFG98907
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcagccuggucgcguccagcgggacgcuggaguucaucaacgagggcuucaacuggaccggggugacccagaacggcggguccaacgccugcaagcggggccccgacugcggcuucuucagccgccucaacuggcuguacaaguccgggagcaccuaccccgugcugaacgucacgaugcccaacaacgacaacuucgacaagcucuacaucuggggcgugcaccacccguccaccgaccaggagcagaccaaccuguacgugcaggccagcgggcgggucaccguguccacgaagcgcagccagcagaccaucauccccaacaucggcucccggcccugggugcgcggccugagcagccggaucuccaucuacuggaccaucgucaagcccggggacauccucgugaucaacagcaacggcaaccugaucgccccgcgcggguacuucaagaugcggaccggcaaguccagcaucaugcgcuccgacgcgcccaucgggacgugcaucagcgagugcaucacccccaacggcuccauccccaacgacaagccguuccagaacgugaacaagaucaccuacggcgccugccccaaguacgucaagcagaacacccugaagcucgccacggggaugcggaacgugcccgagaagcagacccgcggcaucuucggggccaucgccggcuucaucgagaacgggugggagggcaugaucgacggcugguacggguuccggcaccagaacagcgagggcaccgggcaggcggccgaccugaaguccacccaggccgccaucgaccagaucaacggcaagcugaaccgcgugaucgagaagacgaacgagaaguuccaccagaucgagaaggaguucagcgaggucgaggggcggauccaggaccucgagaaguacguggaggacaccaagaucgaccugugguccuacaacgccgagcugcucguggcgcuggagaaccagcacaccaucgaccugaccgacagcgagaugaacaagcuguucgagaagacgcgccggcagcuccgcgagaacgccgaggacaugggcaacggcugcuucaagaucuaccacaagugcgacaacgccugcaucggguccauccggaacggcaccuacaaccacgacgucuaccgcgacgaggcccugaacaaccgcuuccagaucaaggggguggagcucaagagcggcuacaaggacuggauccuguggaucuccuucgccaucagcugcuuccugcucugcgucgugcugcugggcuucaucaugugggcgugccagaaggggaacauccggugcaacaucugcaucuga

SEQ ID NO: 69548 - RNA, 1701 nt, Artificial Sequence
  derived and/or modified sequence opt1 from hemagglutinin__InfluenzaA__AFG98918
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcagccuggucgcguccagcgggacgcuggaguucaucaacgagggcuucaacuggaccggggugacccagaacggcggguccaacgccugcaagcggggccccgaccgcggcuucuucagccggcucaacuggcuguacaaguccgggagcaccuaccccgugcugaacgucacgaugcccaacaacgacaacuucgacaagcucuacaucuggggcgugcaccacccguccaccgaccaggagcagaccaaccuguacgugcaggccagcgggcgcgucaccguguccacgaagcggagccagcagaccaucauccccaacaucggcucccgccccugggugcggggccugagcagccgcaucuccaucuacuggaccaucgucaagcccggggacauccucgugaucaacagcaacggcaaccugaucgccccgcggggguacuucaagaugcgcaccggcaaguccagcaucaugcgguccgacgcgcccaucgggacgugcaucagcgagugcaucacccccaacggcuccauccccaacgacaagccguuccagaacgugaacaagaucaccuacggcgccugccccaaguacgucaagcagaacacccugaagcucgccacggggaugcgcaacgugcccgagaagcagacccggggcaucuucggggccaucgccggcuucaucgagaacgggugggagggcaugaucgacggcugguacggguuccgccaccagaacagcgagggcaccgggcaggcggccgaccugaaguccacccaggccgccaucgaccagaucaacggcaagcugaaccgggugaucgagaagacgaacgagaaguuccaccagaucgagaaggaguucagcgaggucgaggggcgcauccaggaccucgagaaguacguggaggacaccaagaucgaccugugguccuacaacgccgagcugcucguggcgcuggagaaccagcacaccaucgaccugaccgacagcgagaugaacaagcuguucgagaagacgcggcgccagcuccgggagaacgccgaggacaugggcaacggcugcuucaagaucuaccacaagugcgacaacgccugcaucggguccauccgcaacggcaccuacaaccacgacgucuaccgcgacgaggcccugaacaaccgguuccagaucaaggggguggagcucaagagcggcuacaaggacuggauccuguggaucuccuucgccaucagcugcuuccugcucugcgucgugcugcugggcuucaucaugugggcgugccagaaggggaacauccgcugcaacaucugcaucuga

SEQ ID NO: 69549 - RNA, 1701 nt, Artificial Sequence
  derived and/or modified sequence opt1 from hemagglutinin__InfluenzaA__AFG98929
augaagaccgugaucgcccugagcuacaucuucugccucguccugggccaggaccugcccgggaacgacaacuccaccgccacgcucugccugggccaccacgcggugccgaacgggacccuggugaagaccaucaccaacgaccagaucgaggucacgaacgccaccgagcucgugcagagcuccagcaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgucccggacuacgccucccuccgcagccugguggcguccagcgggacgcuggaguucaucaacgagggcuucaacuggaccggggugacccagaacggcggguccaacgccugcaagcggggccccgacaucggcuucuucagccgccucaacuggcuguacaaguccgggagcaccuaccccguccugaacgugacgaugcccaacaacgacaacuucgacaagcucuacaucuggggcgugcaccacccguccaccgaccaggagcagaccaaccuguacguccaggccagcgggcgggugaccguguccacgaagcgcagccagcagaccaucauccccaacaucggcucccggcccuggguccgcggccugagcagccggaucuccaucuacuggaccaucgugaagcccggggacauccucgugaucaacagcaacggcaaccugaucgccccgcgcggguacuucaagaugcggaccggcaaguccagcaucaugcgcuccgacgcgcccaucgggacgugcaucagcgagugcaucacccccaacggcuccauccccaacgacaagccguuccagaacgucaacaagaucaccuacggcgccugccccaaguacgugaagcagaacacccugaagcucgccacggggaugcggaacgugcccgagaagcagacccgcggcaucuucggggccaucgccggcuucaucgagaacgggugggagggcaugaucgacggcugguacggguuccggcaccagaacagcgagggcaccgggcaggcggccgaccugaaguccacccaggccgccaucgaccagaucaacggcaagcugaaccgcgucaucgagaagacgaacgagaaguuccaccagaucgagaaggaguucagcgagguggaggggcggauccaggaccucgagaaguacguggaggacaccaagaucgaccugugguccuacaacgccgagcugcucgucgcgcuggagaaccagcacaccaucgaccugaccgacagcgagaugaacaagcuguucgagaagacgcgccggcagcuccgcgagaacgccgaggacaugggcaacggcugcuucaagaucuaccacaagugcgacaacgccugcaucggguccauccggaacggcaccuacaaccacgacguguaccgcgacgaggcccugaacaaccgcuuccagaucaagggggucgagcucaagagcggcuacaaggacuggauccuguggaucuccuucgccaucagcugcuuccugcucugcguggugcugcugggcuucaucaugugggcgugccagaaggggaacauccggugcaacaucugcaucuga

SEQ ID NO: 69550 - RNA, 1701 nt, Artificial Sequence
  derived and/or modified sequence opt1 from hemagglutinin__InfluenzaA__AFG98940
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcagccuggucgcguccagcgggacgcuggaguucaucaacgagggcuucaacuggaccggggugacccagaacggcggguccaacgccugcaagcggggccccgacagcggcuucuucucccgccucaacuggcuguacaagagcggguccaccuaccccgugcugaacgucacgaugcccaacaaggacaacuucgacaagcucuacaucuggggcgugcaccacccgagcaccgaccaggagcagaccaaccuguacgugcaggccuccgggcgggucaccgugagcacgaagcgcucccagcagaccaucauccccaacaucggcagccggcccugggugcgcggcaugagcucccggaucagcaucuacuggaccaucgucaagcccggggacauccuggugaucaacuccaacggcaaccucaucgccccgcgcggguacuucaagaugcggaccggccgcagcuccaucaugcggagcgacgcgcccaucgggacgugcaucuccgagugcaucacccccaacggcagcauccccaacgaccgcccguuccagaacgugaacaagaucaccuacggcgccugccccaaguacgucaagcagaacacccugaagcuggccacggggaugcggaacgugcccgagaagcagacccgcggcaucuucggggccaucgccggcuucaucgagaacgggugggagggcaugaucgacggcugguacggguuccggcaccagaacuccgagggcaccgggcaggcggccgaccucaagagcacccaggccgccaucgaccagaucaacggcaagcugaaccgcgugaucgagaagacgaacgagaaguuccaccagaucgagaaggaguucuccgaggucgaggggcggauccaggaccuggagaaguacguggaggacaccaagaucgaccucuggagcuacaacgccgagcugcugguggcgcucgagaaccagcacaccaucgaccugaccgacuccgagaugaacaagcuguucgagaagacgcgccggcagcuccgcgagaacgccgaggacaugggcaacggcugcuucaagaucuaccacaagugcgacaacgccugcaucgagagcauccgcaacgggaccuacaaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggcgugccagaagggcaacauccggugcaacaucugcaucuga

SEQ ID NO: 69551 - RNA, 1701 nt, Artificial Sequence
  derived and/or modified sequence opt1 from hemagglutinin__InfluenzaA__AFG98962
augaagaccaucaucgcccugagcuacaucuucugccucgugcuggcccaggaccugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcaacaacccccaccgcauccuggacggcaucaacugcacccugaucgacgcccuccugggggacccccacugcgacggcuuccagaacgagaagugggaccuguucguggagcgguccaaggccuucagcaacugcuaccccuacgacgugccggacuacgcgucccuccgcagccuggucgccuccagcggcacgcuggaguucaucaacgagggguucaacuggaccggcgugacccagaacgggggcuccaacgccugcaagcgggggcccgacagcggcuucuucucccgccucaacuggcuguacaagagcggcuccaccuaccccgugcugaacgucacgaugcccaacaacgacaacuucgacaagcucuacaucuggggcgugcaccacccgagcaccgaccaggagcagaccaaccuguacgugcaggccuccgggcgggucaccgugagcacgaagcgcucccagcagaccaucauccccaacguggggagccggcccuggguccgcggccugagcucccggaucagcaucuacuggaccaucgugaagcccggcgacauccucgugaucaacuccaacgggaaccugaucgcgccgcgcggcuacuucaagaugcggaccggcaagagcuccaucaugcgcagcgacgcccccaucgggacgugcuccagcgagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggaucuucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcugaaccgcgucaucgagaagacgaacgagaaguuccaccagaucgagaaggaguucagcgagguggagggccggauccaggaccucgagaaguacguggaggacaccaagaucgaccugugguccuacaacgcggagcugcucgucgcccuggagaaccagcacaccaucgaccugaccgacagcgagaugaacaagcuguucgagaagacgcgccggcagcuccgcgagaacgccgaggacauggggaacggcugcuucaagaucuaccacaagugcgacaacgccugcaucggcuccauccggaacgggaccuacgaccacgacguguaccgcgacgaggcccugaacaaccgcuuccagaucaagggcgucgagcucaagagcggguacaaggacuggauccuguggaucuccuucgcgaucagcugcuuccugcucugcguggugcugcugggcuucaucaugugggccugccagaagggcaacauccggugcaacaucugcaucuga

SEQ ID NO: 69552 - RNA, 1701 nt, Artificial Sequence
  derived and/or modified sequence opt1 from hemagglutinin__InfluenzaA__AFG98973
augaagaccaucaucgcccugagcuacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaacgagcugguccagagcuccagcaccgggaagaucugcaacaacccccaccggauccucgacggcauggacugcacccugaucgacgcccugcucggggacccccacugcgacggccugcagaacgagaccugggaccuguucguggagcgcuccaaggccuucagcaacugcuaccccuacgacgugccggacuacgccucccuccggagccuggucgcguccagcggcacgcuggaguucaucaacgagggguucaccuggaccggcgugacccagaacgggggcuccaacgccugcaagcgcgggcccgaccggggcuucuucagccgccucaacuggcuguacaaguccggcaacacguaccccgugcugaacgucaccaugcccaacaacgacaacuucgacaagcucuacaucuggggcgugcaccacccgagcaccgaccaggaccagaccucccuguacgugcaggccagcgggcgggucacgguguccaccaagcgcagccagcagaccgugauccccaacaucgggccccggcccuggguccgcggccuguccagcggcaucagcaucuacuggaccaucgugaagccgggggacauccuccugaucaacuccaacggcaaccugaucgcgccccggggguacuucaagaugcgcacgggcaagagcuccaucaugcggagcgacgcccccaucgggaccugcaucuccgagugcaucacccccaacggcagcaucccgaacgacaagcccuuccagaacgugaacaagaucaccuacggcgccugccccaaguacgucaagcagaacacgcucaagcuggccaccgggaugcgcaacgugcccgagaagcagacccggggcaucuucggggccaucgccggcuucaucgagaacgggugggagggcaugaucgacggcugguacggguuccgccaccagaacuccgagggcaccgggcaggcggccgaccucaagagcacgcaggccgccaucgaccagaucaacggcaagcugaaccgggugaucgagaagaccaacgagaaguuccaccagaucgagaaggaguucuccgaggucgaggggcgcauccaggaccuggagaaguacguggaggacaccaagaucgaccuguggagcuacaacgccgagcuccugguggcgcuggagaaccagcacaccaucgaccucacggacuccgagaugaacaagcuguucgagaagacccggcgccagcugcgggagaacgccgaggacaugggcaacggcugcuucaagaucuaccaccgcugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggcuucaucaugugggcgugccagaaggggaacauccggugcaacaucugcaucuga

SEQ ID NO: 69553 - RNA, 1701 nt, Artificial Sequence
  derived and/or modified sequence opt1 from hemagglutinin__InfluenzaA__AFG98984
augaagaccaucaucgcccugagcuacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaccgagcugguccagagcuccagcaccgggaagaucugcaacaacccccaccggauccucgacggcauggacugcacccugaucgacgcccugcucggggacccccacugcgacggccugcagaacgagacgugggaccuguucguggagcgcuccaaggccuucagcaacugcuaccccuacgacgugccggacuacgccucccuccggagccuggucgcguccagcggcacccuggaguucaucaacgagggguucaccuggaccggcgugacgcagaacgggggcuccaacgccugcaagcgcgggcccgaccggggcuucuucagccgccucaacuggcuguacaaguccggcaacaccuaccccgugcugaacgucaccaugcccaacaacgacaacuucgacaagcucuacaucuggggcgugcaccacccgagcaccgaccaggaccagacgucccuguacgugcaggccagcgggcgggucaccguguccaccaagcgcagccagcagaccgugauccccaacaucgggccccggcccuggguccgcggccuguccagcggcaucagcaucuacuggacgaucgugaagccgggggacauccuccugaucaacuccaacggcaaccugaucgcgccccggggguacuucaagaugcgcaccggcaagagcuccaucaugcggagcgacgcccccaucgggaccugcaucuccgagugcaucacccccaacggcagcaucccgaacgacaagcccuuccagaacgugaacaagaucacguacggcgccugccccaaguacgucaagcagaacacccucaagcuggccaccgggaugcgcaacgugcccgagaagcagacccggggcaucuucggggccaucgccggcuucaucgagaacgggugggagggcaugaucgacggcugguacggguuccgccaccagaacuccgagggcacggggcaggcggccgaccucaagagcacccaggccgccaucgaccagaucaacggcaagcugaaccgggugaucgagaagaccaacgagaaguuccaccagaucgagaaggaguucuccgaggucgaggggcgcauccaggaccuggagaaguacguggaggacaccaagaucgaccuguggagcuacaacgccgagcuccugguggcgcuggagaaccagcacacgaucgaccucaccgacuccgagaugaacaagcuguucgagaagacccggcgccagcugcgggagaacgccgaggacaugggcaacggcugcuucaagaucuaccaccgcugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggcuucaucaugugggcgugccagaaggggaacauccggugcaacaucugcaucuga

SEQ ID NO: 69554 - RNA, 1704 nt, Artificial Sequence
  derived and/or modified sequence opt1 from hemagglutinin__InfluenzaA__AFG98995
augaagaccaucaucgcccugagcuacaucuucugccucguguucgcccaggaccugcccggcaacgacaacaacuccaccgcgacgcugugccucgggcaccacgccgucccgaacggcacccuggugaagaccaucaccaacgaccagaucgaggugacgaacgccaccgagcugguccagagcuccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccaacgccugcaagcgggggcccgacaucggcuucuucagccgccugaacuggcucuacaaguccggcagcaccuaccccgugcagaacgucacgaugcccaacaacgacaacuccgacaagcuguacaucuggggcgugcaccacccgagcaccgacaaggagcagaccgaccuguacgugcaggccuccgggaaggucaccgugagcacgaagcggucccagcagaccaucauccccaacguggggagccgccccuggguccggggccucagcucccgcaucagcaucuacuggaccaucgugaagcccggcgacauccuggugaucaacuccaacgggaaccugaucgcgccgcggggcuacuucaagaugcgcaccggcaagagcuccaucaugcggagcgacgcccccaucgggacgugcuccagcgagugcaucacccccaacggguccauccccaacgacaagccguuccagaacgucaacaagaucaccuacggcgccugccccaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucuccuucgcgaucagcugcuuccugcugugcguggugcugcucggcuucaucaugugggccugccagaagggcaacauccgcugcaacaucugcaucuga

SEQ ID NO: 69555 - RNA, 1701 nt, Artificial Sequence
  derived and/or modified sequence opt1 from hemagglutinin__InfluenzaA__AFG99006
augaagaccaucaucgcccugagcuacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaccgagcugguccagagcuccagcaccgggaagaucugcaacaacccccaccggauccucgacggcauggacugcacccugaucgacgcccugcucggggacccccacugcgacggccugcagaacgagacgugggaccuguucguggagcgcuccaaggccuucagcaacugcuaccccuacgacgugccggacuacgccucccuccggagccuggucgcguccagcggcacccuggaguucaucaacgagggguucaccuggaccggcgugacgcagaacgggggcuccaacgccugcaagcgcgggcccgaccggggcuucuucagccgccucaacuggcuguacaaguccggcaacaccuaccccgugcugaacgucaccaugcccaacaacgacaacuucgacaagcucuacaucuggggcgugcaccacccgagcaccgaccaggaccagacgucccuguacgugcaggccagcggccgggucaccguguccaccaagcgcagccagcagaccgugauccccaacaucgggccccggcccuggguccgcggccuguccagccggaucagcaucuacuggacgaucgugaagccgggcgacauccuccugaucaacuccaacgggaaccugaucgcgccccgcggcuacuucaagaugcggaccggcaagagcuccaucaugcgcagcgacgcccccaucgggaccugcaucuccgagugcaucacccccaacgggagcaucccgaacgacaagcccuuccagaacgugaacaagaucacguacggggccugccccaaguacgucaagcagaacacccucaagcuggccaccggcaugcggaacgugcccgagaagcagacccgcgggaucuucggcgccaucgccggguucaucgagaacggcugggaggggaugaucgacggcugguacggcuuccggcaccagaacuccgaggggacgggccaggcggccgaccucaagagcacccaggccgccaucgaccagaucaacgggaagcugaaccgcgugaucgagaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacacgaucgaccucaccgacuccgagaugaacaagcuguucgagaagacccgccggcagcugcgcgagaacgccgaggacauggggaacggcugcuucaagaucuaccaccgcugcgacaacgccugcaucggcagcauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 69556 - RNA, 1701 nt, Artificial Sequence; identical to SEQ ID NO: 61772
  derived and/or modified sequence opt1 from hemagglutinin__InfluenzaA__AFG99017

SEQ ID NO: 69557 - RNA, 1701 nt, Artificial Sequence
  derived and/or modified sequence opt1 from hemagglutinin__InfluenzaA__AFG99028
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcggcaacccccaccgcauccucgacgggaucaacugcacccugaucgacgcccugcucggcgacccccacugcgacggcuuccagaacgagaagugggaccuguucguggagcgguccaaggccuucagcaacugcuaccccuacgacgugccggacuacgcgucccugcgcagccucgucgccuccagcgggacgcuggaguucaucaacgagggcuucaacuggaccggggugacccagaacggcggguccagcgccugcaagcggggccccgacaacggcuucuucucccgccugaacuggcucuacaagagcggguccaccuaccccgugcagaacgucacgaugcccaacaacgacaacagcgacaagcuguacaucuggggcgugcaccacccguccaccgacaaggagcagaccgaccuguacgugcaggccagcgggaaggucaccguguccacgaagcggagccagcagaccgugauccccaacgucggcagccgccccugggugcggggccucuccagccgcguguccaucuacuggaccaucgucaagcccggggacauccuggugaucaacagcaacggcaaccugaucgcgccgcggggguacuucaagaugcgcaccggcaaguccagcaucaugcgguccgacgcccccaucgggacgugcagcuccgagugcaucacccccaacggcagcauccccaacgacaagccguuccagaacgugaacaagaucaccuacggcgccugccccaaguacgucaagcagaacacccucaagcuggccacggggaugcgcaacgugcccgagaagcagacccggggcaucuucggggccaucgcgggcuucaucgagaacgggugggagggcaugaucgacggcugguacggguuccgccaccagaacuccgagggcaccgggcaggccgccgaccucaagagcacccaggccgccaucgaccagaucaacggcaagcugaaccgggugaucgagaagacgaacgagaaguuccaccagaucgagaaggaguucuccgaggucgaggggcgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacaugggcaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgugcugcucggcuucaucaugugggccugccagaaggggaacauccgcugcaacaucugcaucuga

SEQ ID NO: 69558 - RNA, 1701 nt, Artificial Sequence
  derived and/or modified sequence opt1 from hemagglutinin__InfluenzaA__AFG99039
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucgccaugcccaacaacgacaacagcgacaagcuguacaucuggggcgugcaccacccguccacggacaaggagcagaccgaccuguacgugcaggcgagcggcaaggucaccguguccaccaagcggagccagcagacggugauccccaacgucgggagccgccccugggugcggggccucuccagccgcguguccaucuacuggaccaucgucaagcccggcgacauccuggugaucaacagcaacgggaaccugaucgccccgcggggcuacuucaagaugcgcaccgggaaguccagcaucaugcgguccgacgcccccaucgggaccugcagcuccgagugcaucacgcccaacgggagcauccccaacgacaagccguuccagaacgugaacaagaucaccuacggcgccugccccaaguacgucaagcagaacacccucaagcuggccaccggcaugcgcaacgugcccgagaagcagacgcgggggaucuucggcgcgaucgccggguucaucgagaacggcugggaggggaugaucgacggcugguacggcuuccgccaccagaacuccgaggggaccggccaggccgccgaccucaagagcacccaggccgcgaucgaccagaucaacgggaagcugaaccgggugaucgagaagaccaacgagaaguuccaccagaucgagaaggaguucuccgaggucgagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagacccggcgccagcugcgggagaacgccgaggacauggggaacggcugcuucaagaucuaccacaagugcgacaacgccugcaucggcagcauccgcaacgggacguacgaccacgacguguaccgggacgaggcgcucaacaaccgcuuccagaucaagggcguggagcugaaguccggguacaaggacuggauccuguggaucagcuucgccaucuccugcuuccuccugugcgucgugcugcucggcuucaucaugugggccugccagaagggcaacauccgcugcaacaucugcaucuga

SEQ ID NO: 69559 - RNA, 1701 nt, Artificial Sequence; identical to SEQ ID NO: 61772
  derived and/or modified sequence opt1 from hemagglutinin__InfluenzaA__AFG99050

SEQ ID NO: 69560 - RNA, 1701 nt, Artificial Sequence
  derived and/or modified sequence opt1 from hemagglutinin__InfluenzaA__AFG99061
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccgaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuucaagaugcgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacaucaagcagaacacccucaagcuggccacgggcaugcgcaacguccccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaacaaggugaucgagaagacgaacgagaaguuccaccagaucgagaaggaguucuccgagguggagggccggauccaggaccuggagaaguacgucgaggacaccaagaucgaccuguggagcuacaacgcggagcuccugguggcccuggagaaccagcacaccaucgaccucaccgacuccgagaugaacaagcuguucgagaagacgcgccggcagcugcgcgagaacgccgaggacauggggaacggcugcuucaagaucuaccacaagugcgacaacgccugcaucggcagcauccggaacgggaccuacgaccacgacgucuaccgcgacgaggcccucaacaaccgguuccagaucaagggcguggagcugaaguccggguacaaggacuggauccuguggaucagcuucgcgaucuccugcuuccuccugugcgugguccugcucggcuucaucaugugggccugccagaagggcaacauccgcugcaacaucugcaucuga

SEQ ID NO: 69561 - RNA, 1701 nt, Artificial Sequence
  derived and/or modified sequence opt1 from hemagglutinin__InfluenzaA__AFG99072
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaagaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgaccggcuguacaucuggggcgugcaccacccguccaccgacaaggagcagaccgaccuguacgugcaggccagcgggaaggucaccguguccacgaagcgcagccagcagaccgugauccccaacgucgggagccggcccugggugcgcggccucuccagccggguguccaucuacuggaccaucgucaagcccggcgacauccuggugaucaacagcaacgggaaccugaucgcgccgcgcggcuacuucaagaugcggaccgggaaguccagcaucaugcgcuccgacgcccccaucggcacgugcagcuccgagugcaucacccccaacgggagcauccccaacgacaagccguuccagaacgugaacaagaucaccuacggcgccugccccaaguacgucaagcagaacacccucaagcuggccacgggcaugcggaacgugcccgagaagcagacccgcgggaucuucggcgccaucgcgggguucaucgagaacggcugggaggggaugaucgacggcugguacggcuuccggcaccagaacuccgaggggaccggccaggccgccgaccucaagagcacccaggccgccaucgaccagaucaacgggaagcugaaccgcgugaucgagaagacgaacgagaaguuccaccagaucgagaaggaguucuccgaggucgagggccggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgccggcagcugcgcgagaacgccgaggacauggggaacggcugcuucaagaucuaccacaagugcgacaacgccugcaucggcagcauccggaacgggaccuacaaccacgacguguaccgcgacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccggugcaacaucugcaucuga

SEQ ID NO: 69562 - RNA, 1701 nt, Artificial Sequence
  derived and/or modified sequence opt1 from hemagglutinin__InfluenzaA__AFG99083
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaagggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccgaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuucaagaugcucaccgggaaguccagcaucaugcgcuccgacgcccccaucggcacgugcagcuccgagugcaucacccccaacgggagcauccccaacgacaagccguuccagaacgugaacaagaucaccuacggcgccugccccaaguacgucaagcagaacacccugaagcuggccacgggcaugcggaacgugcccgagaagcagacccgcgggaucuucggcgccaucgcgggguucaucgagaacggcugggaggggaugaucgacggcugguacggcuuccggcaccagaacuccgaggggaccggccaggccgccgaccucaagagcacccaggccgccaucgaccagaucaacgggaagcugaaccgcgugaucgagaagacgaacgagaaguuccaccagaucgagaaggaguucuccgaggucgagggccggauccacgaccuggagaaguacguggaggacaccaagaucgaccucuggagcuacaacgcggagcugcuggucgcccucgagaaccagcacaccaucgaccugaccgacuccgagaugaacaagcuguucgagaagacgcgccggcagcuccgcgagaacgccgaggacauggggaacggcugcuucaagaucuaccacaagugcgacaacgccugcaucggcagcauccggaacgggaccuacgaccacgacguguaccgcgacgaggcccugaacaaccgguuccagaucaagggcguggagcugaaguccggguacaaggacuggauccucuggaucagcuucgcgaucuccugcuuccugcugugcgucgugcuccugggcuucaucaugugggccugccagaagggcaacauccgcugcaacaucugcaucuga

SEQ ID NO: 69563 - RNA, 1701 nt, Artificial Sequence
  derived and/or modified sequence opt1 from hemagglutinin__InfluenzaA__AFG99094
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccggggccugcaagcggggccccgacaacggcuucuucagccgccugaacuggcucuacaaguccgggagcaccuaccccgugcagaacgucacgaugcccaacaacgacaacuccgacaagcuguacaucuggggcgugcaccacccgagcaccgacaaggagcagaccgaccuguacgugcaggccuccgggaaggucaccgugagcacgaagcggucccagcagaccgugauccccaacgucggcagccgccccugggugcggggccucagcucccgcgugagcaucuacuggaccaucgucaagcccggggacauccuggugaucaacuccaacggcaaccugaucgcgccgcggggguacuucaagaugcgcaccggcaagagcuccaucaugcggagcgacgcccccaucgggacgugcuccagcgagugcaucacccccaacggcuccauccccaacgacaagccguuccagaacgugaacaagaucaccuacggcgccugccccaaguacgucaagcagaacacccucaagcuggccacggggaugcgcaacgugcccgagaagcagacccggggcaucuucggggccaucgcgggcuucaucgagaacgggugggagggcaugaucgacggcugguacggguuccgccaccagaacagcgagggcaccgggcaggccgccgaccugaaguccacccaggccgccaucgaccagaucaacggcaagcucaaccgggugaucgagaagacgaacgagaaguuccaccagaucgagaaggaguucagcgaggucgaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacggcugcuucaagaucuaccacaagugcgacaacgccugcaucggguccauccgcaacggcaccuacgaccacgacguguaccgggacgaggcccucaacaaccgcuuccagaucaaggggguggagcucaagagcggcuacaaggacuggauccuguggaucuccuucgcgaucagcugcuuccugcugugcgucgugcugcucggcuucaucaugugggccugccagaaggggaacauccgcugcaacaucugcaucuga

SEQ ID NO: 69564 - RNA, 1701 nt, Artificial Sequence
  derived and/or modified sequence opt1 from hemagglutinin__InfluenzaA__AFG99116
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccagcuccggcacgcuggaguucaucaacgagagcuucaacuggaccggggugacccaguccggcgggagcuacgccugcaagcgcggcuccgacaacagcuucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccagcggccgggugaccguguccaccaagcgcagccagcagacgaucaucccgaacaucgggucccggcccuggguccgcggccugagcucccggaucagcaucuacuggaccaucgugaagcccggggacauccugcucaucaacuccaacggcaaccugaucgcgccccgcggcuacuucaagauccggaccggcaagagcuccaucaugcgcagcgacgccccgaucgggaccugcuccagcgagugcaucacgcccaacggguccauccccaacgacaagcccuuccagaacgugaacaagaucaccuacggcgccugcccgaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcugaaccgcgucaucgagaagaccaacgagaaguuccaccagaucgagaaggaguucagcgagguggagggccggauccaggaccucgagaaguacguggaggacacgaagaucgaccugugguccuacaacgcggagcugcucgucgcccuggagaaccagcacaccaucgaccugaccgacagcgagaugaacaagcuguucgagaagacccgccggcagcuccgcgagaacgccgaggacauggggaacggcugcuucaagaucuaccacaagugcgacaacgccugcaucggguccauccgcaacggcacguacgaccacgacguguaccgggacgaggcccugaacaaccgcuuccagaucaagggcgucgagcucaagagcggguacaaggacuggauccuguggaucagcuucgcgaucuccugcuuccugcucugcguggugcugcugggcuucaucaugugggccugccagaaggggaacauccggugcaacaucugcaucuga

SEQ ID NO: 69565 - RNA, 1701 nt, Artificial Sequence
  derived and/or modified sequence opt1 from hemagglutinin__InfluenzaA__AFG99127
augaagaccaucaucgcccugagcuacauccucugccugguguucgcccagaaccugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugguggacgcccuccugggggacccccacugcgacggcuuccagaacgagaagugggaccuguucguggagcgcagcaaggccuucuccaacugcuaccccuacgacgucccggacuacgcgagccuccggucccugguggccagcuccggcacgcuggaguucaucaacgagagcuucaacuggaccggggugacccaguccggcgggagcuacgccugcaagcgcggcuccgacaacagcuucuucucccggcucaacuggcuguacgagagcgaguccaaguaccccguccugaacgugaccaugcccaacaacgggaacuucgacaagcucuacaucuggggcgugcaccaccccagcacggacaaggagcagaccaaccuguacguccgcgccagcggccgggugaccguguccaccaagcgcagccagcagacgaucaucccgaacaucgggucccggcccuggguccgcggccugagcucccggaucagcaucuacuggaccaucgugaagcccggggacauccuccugaucaacuccaacggcaaccugaucgcgccccgcggcuacuucaagauccggaccggcaagagcuccaucaugcgcagcgacgccccgaucgggaccugcuccagcgagugcaucacgcccaacggguccauccccaacgacaagcccuuccagaacgugaacaagaucaccuacggcgccugcccgaaguacgucaagcagaacacccucaagcuggccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcucaaccgcgucaucgagaagaccaacgagaaguuccaccagaucgagaaggaguucagcgagguggagggccggauccaggaccuggagaaguacguggaggacacgaagaucgaccugugguccuacaacgcggagcuccuggucgcccuggagaaccagcacaccaucgaccucaccgacagcgagaugaacaagcuguucgagaagacccgccggcagcugcgcgagaacgccgaggacauggggaacggcugcuucaagaucuaccacaagugcgacaacgccugcaucggguccauccgcaacggcacguacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaaggggaacauccggugcaacaucugcaucuga

SEQ ID NO: 69566 - RNA, 1701 nt, Artificial Sequence
  derived and/or modified sequence opt1 from hemagglutinin__InfluenzaA__AFG99138
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccagcuccggcacgcuggaguucaucaacgagagcuucaacuggaccggggugacccaguccggcgggagcuccgccugcaagcgcggcagcgacaacuccuucuucagccggcugaacuggcucuacgaguccgagagcaaguaccccguccugaacgugaccaugcccaacaacgggaacuucgacaagcuguacaucuggggcgugcaccaccccagcacggacaaggagcagaccaaccucuacguccgcgccuccggccgggugaccgugagcaccaagcgcaaccagcagacggucaucccgaacaucgggucccggcccugggugcgcggccugagcucccggaucagcaucuacuggaccaucgugaagcccggggacauccugcucaucaacuccaacggcaaccugaucgcgccccgcggcuacuucaagauccggaacggcaagagcuccaucaugcgcagcgacgccccgaucgggaccugcuccagcgagugcaucacccccaacggguccauccccaacgacaagcccuuccagaacgucaacaagaucacguacggcgccugcccgaaguacgugaagcagaacacccugaagcucgccaccgggaugcggaacgugcccgagaagcagacccgcggcaucuucggcgccaucgcgggguucaucgagaacggcugggaggggauggucgacggcugguacggguuccggcaccgcaacagcgagggcacgggccaggccgccgaccugaaguccacccaggccgccaucgaccagaucaacgggaagcugaaccgggugaucgagaagaccaacgagaaguuccaccagaucgagaaggaguucagcgagguggagggccgcauccaggaccucgagaaguacgucgaggacaccaagaucgaccugugguccuacaacgcggagcugcucguggcccuggagaaccagcacacgaucgaccugaccgacagcgagaugaacaagcuguucgagaagacccggcgccagcuccgcgagaacgccgaggacauggggaacggcugcuucaagaucuaccacaagugcgacaacgccugcaucggguccauccggaacggcaccuacgaccacgacgucuaccgcgacgaggcccugaacaaccgguuccagaucaagggcguggagcucaagagcggguacaaggacuggauccuguggaucagcuucgcgaucuccugcuuccugcucugcgugguccugcugggcuucaucaugugggccugccagaaggggaacauccgcugcaacaucugcaucuga

SEQ ID NO: 69567 - RNA, 1701 nt, Artificial Sequence
  derived and/or modified sequence opt1 from hemagglutinin__InfluenzaA__AFG99149
augaagaccaucaucgcccugagcuacauccucugccugguguucgcccagaaccugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacgagaagugggaccuguucguggagcgcagccgggccuucuccaacugcuaccccuacgacgugccggacuacgcgagccuccgcucccuggucgccagcuccggcacgcuggaguucaucaacgagggguucaacuggaccggcgugacccagagcgggggcuccuacgccugcaagcgggggagcgacaacuccuucuucagccgccucaacuggcuguacgaguccgagagcaaguaccccgugcugaacgucaccaugcccaacaacggcaaguucgacaagcucuacaucuggggcgugcaccaccccuccacggacaaggagcagaccaaccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccggcaaccugaucgcgccccggggguacuucaagauccgcaccggcaaguccagcaucaugcgguccgacgccccgaucgggacgugcagcuccgagugcaucacccccaacggcagcauccccaacgacaagcccuuccagaacgugaacaagaucaccuacggggccugcccgcgcuacgucaagcagaacacccucaagcuggccacgggcaugcggaacgugcccgagaagcagacccgcggcaucuucggggccaucgcgggcuucaucgagaacgggugggagggcaugguggacgggugguacggcuuccggcaccagaacuccgagggcaccgggcaggccgccgaccugaaguccacccaggccgccaucgaccagaucaacggcaagcucaaccgcgucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacgccgagaugaacaagcuguucgagaagacgcgcaagcagcugcgcgagaacgccgaggacaugggcaacgggugcuucaagaucuaccacaagugcgacaacgccugcaucggcuccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggugcugcucggguucaucaugugggccugccagaagggcaacauccgcugcaacaucugcaucuga

SEQ ID NO: 69568 - RNA, 1701 nt, Artificial Sequence
  derived and/or modified sequence opt1 from hemagglutinin__InfluenzaA__AFG99171
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccagcuccggcacgcuggaguucaccaacgagagcuucaacuggaccggggugacccaguccggcgggagcuacgccugcaagcgcggcuccgacaacagcuucuucucccggcugaacuggcucuacgagagcgaguccaaguaccccguccugaacgugacgaugcccaacaacgggaacuucgacaagcuguacaucuggggcgugcaccaccccagcaccgacaaggagcagaccaaccucuacguccgcgccagcggccgggugaccguguccacgaagcgcaaccagcagaccgucaucccgaacaucgggagccggcccugggugcgcggccuguccagccggaucuccaucuacuggaccaucgugaagcccggggacauccugcucaucaacagcaacggcaaccugaucgcgccccgcggcuacuucaagauccggaacgggaaguccagcaucaugcgcuccgacgccccgaucgggaccugcagcuccgagugcaucacgcccaacggcagcauccccaacgacaagcccuuccagaacgucaacaagaucaccuacggcgccugcccgaaguacgugaagcagaacacccugaagcucgccaccgggaugcggaacgugcccgagaagcagacgcgcggcaucuucggcgccaucgcgggguucaucgagaacggcugggaggggauggucgacggcugguacggguuccggcaccgcaacuccgagggcaccggccaggccgccgaccucaagagcacccaggccgccaucgaccagaucaacgggaagcugaaccgggugaucgagaagaccaacgagaaguuccaccagaucgagaaggaguucuccgagguggagggccgcauccaggaccucgagaaguacgucgaggacacgaagaucgaccuguggagcuacaacgcggagcugcucguggcccuggagaaccagcacaccaucgaccugaccgacuccgagaugaacaagcuguucgagaagacccggcgccagcugcgcgagaacgccgaggacauggggaacggcugcuucaagaucuaccacaagugcgacaacgccugcaucgggagcauccggaacggcacguacgaccacgacgucuaccgcgacgaggcccugaacaaccgguuccagaucaagggcguggagcucaaguccggguacaaggacuggauccuguggaucagcuucgcgaucagcugcuuccugcucugcgugguccugcugggcuucaucaugugggccugccagaaggggaacauccgcugcaacaucugcaucuga

SEQ ID NO: 69569 - RNA, 1701 nt, Artificial Sequence
  derived and/or modified sequence opt1 from hemagglutinin__InfluenzaA__AFG99182
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacgaguccgaguacaaguaccccgcccugaacgucaccaugcccaacaacggcaaguucgacaagcuguacaucuggggcgugcaccaccccagcacggacaaggagcagaccaaccucuacgugcgcgcguccgggcgggucaccgugagcaccaagcgcagccagcagacggugaucccgaacaucggcucccggcccuggguccgcgggcugagcucccggaucagcaucuacuggaccaucgugaagcccggcgacauccugcucaucaacuccaccggcaaccugaucgcgccccgcggguacuucaagauccggaccggcaagagcuccaucaugcgcagcgacgccccgaucgggacgugcuccagcgagugcaucacccccaacggcuccauccccaacgacaagcccuuccagaacgugaacaagaucaccuacggggccugcccgcgguacgucaagcagaacacccugaagcucgccacgggcaugcgcaacgugcccgagaagcagacccggggcaucuucggggccaucgccggcuucaucgagaacgggugggagggcaugguggacgggugguacggcuuccgccaccagaacagcgagggcaccgggcaggccgccgaccugaaguccacccaggccgcgaucgaccagaucaacggcaagcugaaccggcucaucgagaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacgaccacgacgucuaccgggacgaggcgcucaacaaccgcuuccagaucaaggggguggagcugaaguccggcuacaaggacuggauccuguggaucuccuucgccaucagcugcuuccuccugugcgucgugcugcucggguucaucaugugggccugccagaagggcaacauccggugcaacaucugcaucuga

SEQ ID NO: 69570 - RNA, 1701 nt, Artificial Sequence
  derived and/or modified sequence opt1 from hemagglutinin__InfluenzaA__AFG99193
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacgccugcaagcgcggguccgugaacagcuucuucucccggcugaacuggcucuacgagagcgaguccaaguaccccgcccugaacgucaccaugcccaacaacggcaaguucgagaagcuguacaucuggggcgugcaccaccccagcacggacaaggagcagaccaaccucuacgugcgcgcgagcgggcgggucaccguguccaccaagcgcagccagcagacggugaucccgaacaucggcccccggcccuggguccgcgggcuguccagccggaucuccaucuacuggaccaucgugaagcccggcgacauccugcucaucaacagcaccggcaaccugaucgccccgcgcggguacuucaagauccggaccggcaaguccagcaucaugcgcuccgacgcccccaucgggacgugcagcuccgagugcaucacccccaacggcagcauccccaacgacaagccguuccagaacgugaacaagaucaccuacggggccugcccccgguacgucaagcagaacacccugaagcucgccacgggcaugcgcaacgugcccgagaagcagacccggggcaucuucggggcgaucgccggcuucaucgagaacgggugggagggcaugguggacgggugguacggcuuccgccaccagaacuccgagggcaccgggcaggccgccgaccucaagagcacccaggccgcgaucgaccagaucaacggcaagcugaaccggcucaucgagaagacgaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacaugggcaacgggugcuucaagaucuaccacaagugcgacaacgccugcaucggcagcauccgcaacggcaccuacgaccacgacgucuaccgggacgaggcgcugaacaaccgcuuccagaucaaggggguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 69571 - RNA, 1701 nt, Artificial Sequence
  derived and/or modified sequence opt1 from hemagglutinin__InfluenzaA__AFG99204
augaagaccaucaucgcccugagcuacaucuucugccucggcuucgcccagaagcugcccgggaacgacaacuccaccgcgacgcugugccucggccaccacgccgugccgaacgggacccuggucaagaccaucaccaacgaccagaucgaggugacgaacgccaccgagcuggugcagagcuccagcaccggccgcaucugcgacagcccccaccggauccucgacgggaagaacugcacccugaucgacgcccugcucggcgacccccacugcgacggcuuccagaacgagaagugggaccuguucgucgagcgcagcaaggccuucuccaacugcuaccccuacgacgugccggacuacgcgagccugcggucccucguggccagcuccgggacgcuggaguucaucaacgagggcuucaacuggaccggggucacccagagcggcggguccuacgccugcaagcgcggcagcgugaacuccuucuucagccggcugaacuggcucuacaaguccgagagcaaguaccccgcccugaacgugaccaugcccaacaacggcaaguucgacaagcuguacaucuggggcguccaccaccccuccacggacaaggagcagaccaaccucuacgugcgcgcgagcgggcgggugaccgucagcaccaagcgcucccagcagacggugaucccgaacaucgggagccggcccugggugcgcggccuguccagccggaucuccaucuacuggaccaucgucaagcccggcgacauccugcucaucaacagcaccgggaaccugaucgcgccccgcggcuacuucaagauccggaccgggaaguccagcaucauccgcuccgacgccccgaucggcacgugcagcuccgagugcaucacccccaacgggagcauccccaacgacaagcccuuccagaacgugaacaagaucaccuacggcgccugcccgcgguacgugaagcagaacacccugaagcucgccacgggcaugcgcaacguccccgagaagcagacccgggggaucuucggcgccaucgccggguucaucgagaacggcugggaggggaugguggacggcugguacggcuuccgccaccagaacuccgaggggaccggccaggccgccgaccugaaguccacccaggccgcgaucgaccagaucaacgggaagcugaaccggcucaucgagaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgcggaagcagcugcgcgagaacgccgaggacauggggaacggcugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 69572 - RNA, 1701 nt, Artificial Sequence
  derived and/or modified sequence opt1 from hemagglutinin__InfluenzaA__AFG99215
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgagccugcggucccucguggccagcuccggcacgcuggaguucaucaacgagggguucaacuggaccggcgucacccagagcgggggcuccuacgccugcaagcgcgggagcgugaacuccuucuucagccggcugaacuggcucuacgaguccgaguacaaguaccccgcccugaacgugaccaugcccaacaacggcaaguucgacaagcuguacaucuggggcguccaccaccccagcacggagaaggagcagaccaaccucuacgugcgcgcguccgggcgggugaccgucagcaccaagcgcagccagcagacggugaccccgaacaucggcucccggcccugggugcgcgggcugagcucccggaucagcaucuacuggaccaucgucaagcccggcgacauccugcucaucaacuccaccggcaaccugaucgcgccccgcggguacuucaagauccggacgggcaagagcuccaucaugcgcagcgacgccccgaucgggaccugcuccagcgagugcaucacccccaacggcuccauccccaacgacaagcccuuccagaacgugaacaagaucaccuacggggccugcccgcgguacgugaagcagaacacgcugaagcucgccaccggcaugcgcaacguccccgagaagcagacccggggcaucuucggggccaucgccggcuucaucgagaacgggugggagggcaugguggacgggugguacggcuuccgccaccagaacagcgagggcaccgggcaggccgccgaccugaaguccacgcaggccgcgaucgaccagaucaacggcaagcugaaccggcucaucgagaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucacggacagcgagaugaacaagcuguucgagaagacccggaagcagcugcgcgagaacgccgaggacaugggcaacgggugcuucaagaucuaccacaagugcgacaacgccugcaucggcuccauccgcaacggcaccuacgaccacgacguguaccgggacgaggcgcucaacaaccgcuuccagaucaagggggucgagcugaaguccggcuacaaggacuggauccuguggaucuccuucgccaucagcugcuuccuccugugcgugguccugcucggguucaucaugugggccugccagaagggcaacauccggugcaacaucugcaucuga

SEQ ID NO: 69573 - RNA, 1701 nt, Artificial Sequence
  derived and/or modified sequence opt1 from hemagglutinin__InfluenzaA__AFG99226
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacgaguccgaguacaaguaccccgcccugaacgucaccaugcccaacaacggcaaguucgacaagcuguacaucuggggcgugcaccaccccagcacggacaaggagcagaccaaccucuacgugcgcgcguccgggcgggucaccgugagcaccaagcgcagccagcagacggugaucccgaacaucggcucccggcccuggguccgcgggcugagcucccggaucagcaucuacuggaccaucgugaagcccggcgacauccuguccaucaacagcaccggcaaccucaucgcgccccgcggguacuucaagauccggaccggcaaguccagcaucaugcgcuccgacgccccgaucgggacgugcagcuccgagugcaucacccccaacggcagcauccccaacgacaagcccuuccagaacgugaacaagaucaccuacggggccugcccgcgguacgucaagcagaacacccugaagcuggccacgggcaugcgcaacgugcccgagaagcagacccggggcaucuucggggccaucgccggcuucaucgagaacgggugggagggcaugguggacgggugguacggcuuccgccaccagaacuccgagggcaccgggcaggccgccgaccucaagagcacccaggccgcgaucgaccagaucaacggcaagcugaaccggcugaucgagaagacgaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugaccgacuccgagaugaacaagcuguucgagaagacgcggaagcagcuccgcgagaacgccgaggacaugggcaacgggugcuucaagaucuaccacaagugcgacaacgccugcaucggcagcauccgcaacggcaccuacgaccacgacgucuaccgggacgaggcgcugaacaaccgcuuccagaucaaggggguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 69574 - RNA, 1701 nt, Artificial Sequence
  derived and/or modified sequence opt1 from hemagglutinin__InfluenzaA__AFG99237
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcgagagcgugaacuccuucuucagccggcugaacuggcucuacgaguccgaguacaaguaccccgcccugaacgucaccaugcccaacaacggcaaguucgagaagcuguacaucuggggcgugcaccaccccagcacggacaaggagcagaccaaccucuacgugcgcgcguccgggcgggucaccgugagcaccaagcgcagccagcagacggugaucccgaacaucggcucccggcccuggguccgcgggcugagcucccggaucagcaucuacuggaccaucgugaagcccggcgacauccugcucaucaacuccaccgggaaccugaucgcgccccgcggcuacuucaagauccggaccggcaagagcuccaucaugcgcagcgacgccccgaucgggacgugcuccagcgagugcaucacccccaacggcuccauccccaacgacaagcccuuccagaacgugaacaagaucaccuacggggccugcccgcgguacguccgccagaacacccugaagcucgccacgggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccugaaguccacccaggccgcgaucgaccagaucaacggcaagcugaaccgccucaucgagaagacgaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacaugggcaacgggugcuucaagaucuaccacaagugcgacaacgccugcaucggcuccauccggaacgggaccuacgaccacgacgucuaccgcgacgaggcgcucaacaaccgguuccagaucaagggcguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 69575 - RNA, 1701 nt, Artificial Sequence
  derived and/or modified sequence opt1 from hemagglutinin__InfluenzaA__AFG99248
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcgggucccacgccugcaagcgcggcagcgugaacuccuucuucagccggcugaacuggcuccacgaguccgaguacaaguaccccgcccugaacgucaccaugcccaacaacgggaaguucgacaagcuguacaucuggggcgugcaccaccccaucacggaccgcgagcagaccaaccucuacgugcgggcgagcggccgcgucaccguguccaccaagcggagccagcagacggugaucccgaacaucggguuccgccccuggguccggggccugagcucccgcaucagcaucuacuggaccaucgugaagcccggggacauccugcucaucaacuccaccggcaaccugaucgcgccccggggcuacuucaagauccgcaacggcaagagcuccaucaugcggagcgacgccccgaucgggaccugcuccagcgagugcaucacgcccaacggguccauccccaacgacaagcccuuccagaacgugaacaagaucaccuacggcgccugcccgcgcuacgucaagcagaacacccugaagcucgccaccgggaugcggaacgugcccgagaagcagacgcgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgcgagaacgccgaggacauggggaacggcugcuucaagaucuaccacaagugcgacaacgccugcaucggguccauccggaacggcacguacgaccacgacgucuaccgcgacgaggcgcucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 69576 - RNA, 1701 nt, Artificial Sequence
  derived and/or modified sequence opt1 from hemagglutinin__InfluenzaA__AFG99259
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagguggaggucacgaacgccaccgagcuggugcagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgucccggacuacgcgagccugcggucccucguggccagcuccggcacgcuggaguucaucaacgaggacuucaacuggaccggggugacccagagcggcggguccuacgccugcaagcgcggcagcgucaacuccuucuucagccggcugaacuggcuccacaaguccgaguacaaguaccccgcccugaacgugaccaugcccaacaacgggaaguucgacaagcuguacaucuggggcgugcaccaccccagcacggaccgcgagcagaccaaccucuacguccgggcguccggccgcgugaccgugagcaccaagcggagccagcagacggucaucccgaacaucgggucccgccccugggugcggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggcgucgagcucaagagcggguacaaggacuggauccuguggaucuccuucgccaucagcugcuuccugcugugcguggugcugcucggcuucaucaugugggccugccagaaggggaacauccgcugcaacaucugcaucuga

SEQ ID NO: 69577 - RNA, 1701 nt, Artificial Sequence
  derived and/or modified sequence opt1 from hemagglutinin__InfluenzaA__AFG99270
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacaaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccacaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 69578 - RNA, 1701 nt, Artificial Sequence
  derived and/or modified sequence opt1 from hemagglutinin__InfluenzaA__AFG99281
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgaggaguucaacuggaccggggugacccagagcggcggguccuacgccugcaagcgcggcagcgugaacuccuucuucagccggcugaacuggcuccacaaguccgaguacaaguaccccgcccugaacgucaccaugcccaacaacgggcgcuucgacaagcuguacaucuggggcgugcaccaccccagcacggaccgggagcagaccaaccucuacgugcgcgcguccggccgggucaccgugagcaccaagcgcagccagcagacggugaucccgaacaucgggccccggcccuggguccgcggccuguccagccggaucuccaucuacuggaccaucgugaagcccggggacauccugcucaucaacagcaccggcaaccugaucgccccgcgcggcuacuucaagauccacaccgggaaguccagcaucaugcgguccgacgcccccaucggcacgugcagcuccgagugcaucacccccaacgggagcauccccaacgacaagccguuccagaacgugaacaagaucaccuacggcgccugcccccgcuacgucaagcagaacacccugaagcucgccacggggaugcggaacgugcccgacaagcagacccgcggcaucuucggcgcgaucgccggguucaucgagaacggcugggaggggaugguggacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaagggcguggagcugaaguccggguacaaggacuggauccuguggaucagcuucgccaucuccugcuuccuccugugcgucgugcugcucggcuucaucaugugggccugccagaaggggaacauccgcugcaacaucugcaucuga

SEQ ID NO: 69579 - RNA, 1701 nt, Artificial Sequence
  derived and/or modified sequence opt1 from hemagglutinin__InfluenzaA__AFG99292
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagguggaggucacgaacgccaccgagcuggugcagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgucccggacuacgcgagccugcggucccucguggccagcuccggcacgcuggaguucaucaacgaggacuucaacuggaccggggugacccagagcggcggguccuacgccugcaagcgcggcagcgucaacuccuucuucagccggcugaacuggcuccacgaguccgaguacaaguaccccgcccugaacgugaccaugcccaacaacgggaaguucgacaagcuguacaucuggggcgugcaccaccccagcacggaccgcgagcagaccaaccucuacguccgggcguccggccgcgugaccgugagcaccaagcggagccagcagacggucaucccgaacaucgggucccgccccugggugcggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggcgucgagcucaagagcggguacaaggacuggauccuguggaucuccuucgccaucagcugcuuccugcugugcguggugcugcucggcuucaucaugugggccugccagaaggggaacauccgcugcaacaucugcaucuga

SEQ ID NO: 69580 - RNA, 1701 nt, Artificial Sequence
  derived and/or modified sequence opt1 from hemagglutinin__InfluenzaA__AFG99303
augaagaccaucaucgcccugagcuacaucuucugccucguggucgcccagaagcugcccggcaacgacaacuccaccgcgacgcugugccucgggcaccacgccgugccgaacggcacccuggugaagaccaucaccaacgaccagaucgaggucacgaacgccaccgagcuggugcagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgucccggacuacgcgagccugcggucccucguggccagcuccggcacgcuggaguucaucaacgaggacuucaacuggaccgggguggcccagagcggcggguccuacgccugcaagcgcggcagcgucaacuccuucuucagccggcugaacuggcuccacgaguccgaguacaaguaccccgcgcugaacgugaccaugcccaacaacgggaaguucgacaagcuguacaucuggggcgugcaccaccccagcaccgaccgcgagcagacgaaccucuacguccgggccuccggccgcgugaccgugagcaccaagcggagccagcagaccgucaucccgaacaucgggucccgccccugggugcggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccaucagcaacgacaagcccuuccagaacgucaaccgcaucaccuacggcgccugcccccgguacgugaagcagaacacccugaagcucgccaccgggaugcgcaacgugccggagaagcagacgcggggcaucuucggcgccaucgccggguucaucgagaacggcugggaggggauggucgacggcugguacggguuccgccaccagaacuccgagggcaccggccaggccgccgaccugaaguccacccaggcggccaucgaccagaucaacgggaagcugaaccggcucaucgagaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggcgucgagcugaaguccggguacaaggacuggauccuguggaucagcuucgccaucagcugcuuccuccugugcguggugcugcucggcuucaucaugugggccugccagaaggggaacauccggugcaacaucugcaucuga

SEQ ID NO: 69581 - RNA, 1701 nt, Artificial Sequence
  derived and/or modified sequence opt1 from hemagglutinin__InfluenzaA__AFG99314
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacagcuuccagaacgagaagugggaccuguucguggagcgcuccaaggccuacagcaacugcuaccccuacgacgugccggacuacgcgucccugcggagccucgucgccuccagcggcacgcuggaguucaucaacgaggacuucaacuggaccggcgugacccaguccgggggcagcuacgccugcaagcgcggguccgugaacagcuucuucucccggcugaacuggcuccacgagagcgaguacaaguaccccgcccugaacgucaccaugcccaacaacggcaaguucgacaagcuguacaucugggggauccaccaccccuccacggaccgcgagcagaccaaccucuacgugcgggcgagcggccgcgugaccgucagcaccaagcggucccagcagacggugaucccgaacaucggcagccgccccugggugcgggggcuguccagccgcaucuccaucuacuggaccaucgucaagcccggcgacauccugcucaucaacagcaccgggaaccugaucgcgccccggggcuacuucaagcugcgcaccggcaaguccagcaucaugcgguccgacgccccgaucgggacgugcagcuccgagugcaucacccccaacggcagcauccccaacgacaagcccuuccagaacgugaacaagaucaccuacggggccugcccgcgcuacgugaagcagaacacccucaagcuggccacgggcaugcggaacguccccgagaagcagacccgcgggaucuucggcgccaucgccggcuucaucgagaacgggugggagggcaugguggacgggugguacggcuuccggcaccagaacuccgaggggaccggccaggccgccgaccugaaguccacccaggccgcgaucgaccagaucaacggcaagcucaaccgccugaucgagaagacgaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcgcaagcagcuccgcgagaacgccgaggacaugggcaacgggugcuucaagaucuaccacaagugcgacaacgccugcaucggcagcauccggaacgggaccuacgaccacgacguguaccgcgacgaggcgcugaacaaccgguuccagaucaagggcgucgagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 69582 - RNA, 1701 nt, Artificial Sequence
  derived and/or modified sequence opt1 from hemagglutinin__InfluenzaA__AFG99336
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacaaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 69583 - RNA, 1701 nt, Artificial Sequence
  derived and/or modified sequence opt1 from hemagglutinin__InfluenzaA__AFG99347
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacaagcccgaguacaaguaccccgcgcugaacgucaccaugcccaacaacgggaaguucgacaagcuguacaucuggggcgugcaccacccguccaccgaccgcgagcagacgaaccucuacgugcgggccagcggccgcgucaccguguccaccaagcggagccagcagaccgugauccccaacaucgggagccgccccuggguccggggccuguccagccgcaucuccaucuacuggacgaucgugaagcccggggacauccugcucaucaacagcaccggcaaccugaucgccccgcggggcuacuucaagauccgcaccgggaaguccagcaucaugcgguccgacgcccccaucgggaccugcagcuccgagugcaucacgcccaacggcagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcugaaccggcucaucgacaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 69584 - RNA, 1701 nt, Artificial Sequence
  derived and/or modified sequence opt1 from hemagglutinin__InfluenzaA__AFG99358
augaagaccaucaucgcccugagccacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccucagcucccggaucagcaucuacuggaccaucgugaagcccggggacauccugcugaucaacuccaucggcaaccucaucgcgccccgcggcuacuucaagauccggaacgggaaguccuccaucaugcgcagcgacgugccgaucggcaacugcuccagcgagugcaucacccccaacggguccauccccaacgacaagcccuuccagaacgucaaccggaucaccuacggcgccugcccgcgcuacgugaagcagaacacgcugaagcuggccaccgggaugcggaacgugcccgagaagcagacccgcggcaucuucggcgccaucgccggguucaucgagaacggcugggaggggauggucgacggcugguacggguuccggcaccagaacagcgagggcaccggccaggccgccgaccucaaguccacgcaggccgcgaucgaccagaucaacgggaagcugaaccgccugaucgagaagaccaacgagaaguuccaccagaucgagaaggaguucagcgagguggagggccggauccaggaccucgagaaguacguggaggacaccaagaucgaccugugguccuacaacgccgagcugcucgucgcccuggagaaccagcacaccaucgaccugacggacagcgagaugaacaagcuguucgagaagacccgcaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggcgucgagcucaagagcggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 69585 - RNA, 1701 nt, Artificial Sequence
  derived and/or modified sequence opt1 from hemagglutinin__InfluenzaA__AFG99369
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacugggccgggguggcccagagcggcggguccuacgcgugcaagcgcggcagcgugaacuccuucuucagccggcugaacuggcuccacgaguccgaguacaaguaccccgcccugaacgucaccaugcccaacaacgggaaguucgacaagcuguacaucuggggcgugcaccaccccagcaccgaccgcgagcagaccaaccucuacgugcgggccuccggccgcgucacggugagcaccaagcggagccagcagaccgugaucccgaacaucgggucccgccccuggguccggggccugagcucccgcaucagcaucuacuggaccaucgugaagcccggggacauccugcucaucaacuccacgggcaaccugaucgcgccccggggcuacuucaagauccgcaccggcaagagcuccaucaugcggagcgacgccccgaucgggaccugcuccagcgagugcaucacccccaacggguccauccccaacgacaagcccuuccagaacgugaaccgcaucacguacggcgccugcccgcgguacgucaagcagaacacccugaagcucgccaccgggaugcgcaacgugcccgagaagcagacccggggcaucuucggcgccaucgccggguucaucgagaacggcugggaggggaugguggacggcugguacggguuccgccaccagaacagcgagggcacgggccaggccgcggaccugaaguccacccaggccgccaucgaccagaucaacgggaagcugaaccggcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagacccgcaagcagcugcgggagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaagggcguggagcugaaguccggguacaaggacuggauccuguggaucuccuucgccacgagcugcuuccuccugugcgucgugcugcucggcuucaucaugugggccugccagaaggggaacauccggugcaacaucugcaucuga

SEQ ID NO: 69586 - RNA, 1701 nt, Artificial Sequence
  derived and/or modified sequence opt1 from hemagglutinin__InfluenzaA__AFG99380
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 69587 - RNA, 1701 nt, Artificial Sequence; identical to SEQ ID NO: 69586
  derived and/or modified sequence opt1 from hemagglutinin__InfluenzaA__AFG99391

SEQ ID NO: 69588 - RNA, 1701 nt, Artificial Sequence
  derived and/or modified sequence opt1 from hemagglutinin__InfluenzaA__AFG99402
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcuccacaaguccgaguacaaguaccccgcccugaacgucaccaugcccaacaacgggaaguucgacaagcuguacaucuggggcgugcaccaccccgugacggaccgcgagcagaccaaccucuacguccgggcgagcggccgcgugaccguguccaccaagcggagccagcagacggucaucccgaacaucgggagccgccccugggugcggggccuguccagccgcaucuccaucuacuggaccaucgugaagcccggggacauccugcucaucaacagcaccggcaaccugaucgcgccccggggcuacuucaagauccgcaccgggaaguccagcaucaugcgguccgacgccccgaucggcacgugcagcuccgagugcaucacccccaacgggagcauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaagggcgucgagcugaaguccggguacaaggacuggauccuguggaucagcuucgccaucuccugcuuccuccugugcguggugcugcucggcuucaucaugugggccugccagaaggggaacauccgcugcaacaucugcaucuga

SEQ ID NO: 69589 - RNA, 1701 nt, Artificial Sequence
  derived and/or modified sequence opt1 from hemagglutinin__InfluenzaA__AFG99413
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgccggcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 69590 - RNA, 1701 nt, Artificial Sequence
  derived and/or modified sequence opt1 from hemagglutinin__InfluenzaA__AFG99424
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacaaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgccggcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 69591 - RNA, 1701 nt, Artificial Sequence
  derived and/or modified sequence opt1 from hemagglutinin__InfluenzaA__AFG99435
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaacagcuccaccgggcgcaucugcgacagcccccaccggauccucgacggcaagaacugcacccugaucgacgcccugcucggggacccccacugcgacggccugcagaacaaggagugggaccuguucguggagcgcuccaaggccuacagcaacugcuaccccuacgacgugccggacuacgcgucccuccggagccuggucgccuccagcggcacgcuggaguucaccaaggaggacuucaacuggaccgggguggcccaguccggcgggagcuacgccugcaagcgcggcuccgugaacagcuucuucucccggcucaacuggcugcacgagagcgaguacaaguaccccgcgcugaacgucaccaugcccaacaacgggaaguucgacaagcucuacaucuggggcgugcaccaccccuccacggaccgcgagcagaccaaccuguacgugcgggccagcggccgcgucaccguguccaccaagcggagccagcagacggugaucccgaacaucgggagccgccccuggguccggggccuguccagccgcaucuccaucuacuggaccaucgugaagcccggggacauccuccugaucaacagcaccggcaaccugaucgcgccccggggcuacuucaagauccgcaccgggaaguccagcaucaugcgguccgacgccccgaucggcacgugcagcuccgagugcaucacccccaacgggagcauccccaacgacaagcccuuccagaacgugaaccgcaucaccuacggcgccugcccgcgguacgucaagcagaacacccucaagcuggccacggggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacccaggcggccaucgaccagaucaacgggaagcugaaccggcugaucgagaagacgaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 69592 - RNA, 1701 nt, Artificial Sequence; identical to SEQ ID NO: 69591
  derived and/or modified sequence opt1 from hemagglutinin__InfluenzaA__AFG99446

SEQ ID NO: 69593 - RNA, 1701 nt, Artificial Sequence
  derived and/or modified sequence opt1 from hemagglutinin__InfluenzaA__AFG99457
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcggguccuacgccugcaagcgcggcagcgugaacuccuucuucagccggcucaacuggcugcacaaguccgaguacaaguaccccgcgcugaacgucaccaugcccaacaacgggaaguucgacaagcucuacaucuggggcgugcaccaccccagcaccgaccgcgaccagacgucccuguacgugcgggccagcggccgcgucaccgugagcaccaagcggucccagcagaccgugaucccgaacaucgggagccgccccuggguccggggccaguccagccgcaucuccaucuacuggacgaucgugaagcccggggacauccugcucaucaacagcaccggcaaccugaucgcgccccggggcuacuucaagauccgcaacgggaaguccagcaucaugcgguccgacgccccgaucgggaccugcagcuccgagugcaucacccccaacggcagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggcgccaucgccggguucaucgagaacggcugggaggggaugguggacggcugguacggguuccgccaccagaacuccgagggcacgggccaggccgccgaccugaaguccacccaggcggccaucgaccagaucaacgggaagcugaaccggcucaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaagggcguggagcugaaguccggguacaaggacuggauccuguggaucagcuucgccaucagcugcuuccuccugugcgucgugcugcucggcuucaucaugugggccugccagaaggggaacauccggugcaacaucugcaucuga

SEQ ID NO: 69594 - RNA, 1701 nt, Artificial Sequence
  derived and/or modified sequence opt1 from hemagglutinin__InfluenzaA__AFG99468
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagauggacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 69595 - RNA, 1701 nt, Artificial Sequence
  derived and/or modified sequence opt1 from hemagglutinin__InfluenzaA__AFG99490
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacgcgagccuccggucccugguggccagcuccggcacgcuggaguucaucaacgaggacuucaacuggaccggggucgcccagagcggcgaguccuacgccugcaagcgcgggagcgugaaguccuucuucagccggcucaacuggcugcacgaguccgaguacaaguaccccgcgcugaacgugaccaugcccaacaacggcaaguucgacaagcucuacaucuggggcguccaccaccccagcaccgaccgcgagcagacgucccuguacgugcgggccagcgggcgcgugaccgucagcaccaagcggucccagcagaccgugaucccgaacaucggcagccgccccugggugcgggggcuguccagccgcaucuccaucuacuggacgaucgucaagcccggcgacauccuccugaucaacagcaccgggaaccugaucgcgccccggggcuacuucaagauccgcaccggcaaguccagcaucaugcgguccgacgccccgaucgggaccugcagcuccgagugcaucacgcccaacggcagcauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagaccaacgagaaguuccaccagaucgagaaggaguucuccgagguggaggggcgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 69596 - RNA, 1701 nt, Artificial Sequence
  derived and/or modified sequence opt1 from hemagglutinin__InfluenzaA__AFG99501
augaagaccaucaucgcccugagcuacaucuucugccucguggucgcccagaagcugcccggcaacgacaacuccaccgcgacgcugugccucgggcaccacgccgugccgaacggcacccuggugaagaccaucaccaacgaccagaucgaggucacgaacgccaccgagcuggugcagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgucccggacuacgcgagccugcggucccucguggccagcuccggcacgcuggaguucaucaacgaggacuucaacuggaccgggguggcccagagcggcggguccuacacgugcaagcgcggcagcgucaacuccuucuucagccggcugaacuggcuccacgaguccgaguacaaguaccccgcccugaacgugaccaugcccaacaacgggaaguucgacaagcuguacaucuggggcgugcaccaccccagcaccgaccgcgagcagaccaaccucuacguccgggcguccggccgcgugaccgugagcaccaagcggagccagcagacggucaucccgaacaucgggucccgccccugggugcggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccaucagcaacgacaagcccuuccagaacgucaaccgcaucaccuacggcgccugcccccgguacgugaagcagaacacccugaagcucgccacggggaugcgcaacgugccggagaagcagacccggggcaucuucggcgccaucgccggguucaucgagaacggcugggaggggauggucgacggcugguacggguuccgccaccagaacuccgagggcaccggccaggccgccgaccucaagagcacccaggccgcgaucgaccagaucaacgggaagcugaaccggcugaucgagaagacgaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgcgcaagcagcugcgggagaacgccgaggacauggggaacggcugcuucaagaucuaccacaagugcgacaacgccugcaucgggagcauccgcaacggcaccuacgaccacgacguguaccgggacgaggcgcucaacaaccgcuuccagaucaagggcgucgagcugaaguccggguacaaggacuggauccuguggaucagcuucgccaucagcugcuuccuccugugcguggugcugcucggcuucaucaugugggccugccagaaggggaacauccggugcaacaucugcaucuga

SEQ ID NO: 69597 - RNA, 1701 nt, Artificial Sequence
  derived and/or modified sequence opt1 from hemagglutinin__InfluenzaA__AFG99512
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgacuccuacgccugcaagcgcgggagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgaccgcgagcagacgucccuguacauccgggccagcgggcgcgugaccgucagcaccaagcggucccagcagaccgugaucccgaacaucggcagccgccccugggugcggggccuguccagccgcaucuccaucuacuggacgaucgucaagcccggggacauccuccugaucaacagcaccggcaaccugaucgcgccccggggguacuucaagauccgcaccggcaaguccagcaucaugcgguccgacgccccgaucgggaccugcagcuccgagugcaucacgcccaacggcagcauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucgaccagaucaacggcaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggagcauccgcaacggcacguacgaccacgacguguaccgggacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 69598 - RNA, 1701 nt, Artificial Sequence
  derived and/or modified sequence opt1 from hemagglutinin__InfluenzaA__AFG99523
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgagucccaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 69599 - RNA, 1701 nt, Artificial Sequence; identical to SEQ ID NO: 69495
  derived and/or modified sequence opt1 from hemagglutinin__InfluenzaA__AFG99534

SEQ ID NO: 69600 - RNA, 1701 nt, Artificial Sequence; identical to SEQ ID NO: 69495
  derived and/or modified sequence opt1 from hemagglutinin__InfluenzaA__AFG99545

SEQ ID NO: 69601 - RNA, 1701 nt, Artificial Sequence
  derived and/or modified sequence opt1 from hemagglutinin__InfluenzaA__AFG99556
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccggaaguccacccaggcggccaucgaccagaucaacggcaagcugaaccgccucaucgagaagacgaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgcggaagcagcugcgcgagaacgccgaggacaugggcaacgggugcuucaagaucuaccacaagugcgacaacgcgugcaucggcagcauccggaacgggaccuacgaccacgacgucuaccgcgacgaggcccucaacaaccgguuccagaucaagggcguggagcugaaguccggcuacaaggacuggauccuguggaucagcuucgccaucagcugcuuccuccugugcgucgugcugcucggguucaucaugugggccugccagaagggcaacauccgcugcaacaucugcaucuga

SEQ ID NO: 69602 - RNA, 1701 nt, Artificial Sequence; identical to SEQ ID NO: 69495
  derived and/or modified sequence opt1 from hemagglutinin__InfluenzaA__AFG99567

SEQ ID NO: 69603 - RNA, 1701 nt, Artificial Sequence; identical to SEQ ID NO: 69495
  derived and/or modified sequence opt1 from hemagglutinin__InfluenzaA__AFG99578

SEQ ID NO: 69604 - RNA, 1701 nt, Artificial Sequence; identical to SEQ ID NO: 69495
  derived and/or modified sequence opt1 from hemagglutinin__InfluenzaA__AFG99589

SEQ ID NO: 69605 - RNA, 1701 nt, Artificial Sequence
  derived and/or modified sequence opt1 from hemagglutinin__InfluenzaA__AFG99600
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccgggugcuggacggcaagaacugcacccugaucgacgcccuccugggggacccccacugcgacggcuuccagaacaaggagugggaccuguucguggagcgcagcaaggccuacuccaacugcuaccccuacgacgucccggacuacgcgagccuccggucccugguggccagcuccggcacgcuggaguucaccaacgaggacuucaacuggaccgggguggcccagagcggcgaguccuacgccugcaagcgcgggagcgucaaguccuucuucagccggcucaacuggcugcacgaguccgacuacaaguaccccgcgcugaacgugaccaugcccaacaacggcaaguucgacaagcucuacaucuggggcgugcaccaccccagcacggaccgcgagcagaccucccuguacguccgggccagcgggcgcgugaccgugagcaccaagcggucccagcagacggucaucccgaacaucggcagccgccccugggugcgggggcuguccagccgcaucuccaucuacuggaccaucgugaagcccggcgacauccuccugaucaacagcaccgggaaccugaucgcgccccggggcuacuucaagauccgcaucggcaaguccagcaucaugcgguccgacgccccgaucgggaccugcagcuccgagugcaucacgcccaacggcagcauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccugaaguccacccaggcggccaucgaccagaucaacggcaagcucaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcugaaguccggcuacaaggacuggauccucuggaucagcuucgccaucagcugcuuccugcugugcguggugcuccugggguucaucaugugggccugccagaagggcaacauccggugcaacaucugcaucuga

SEQ ID NO: 69606 - RNA, 1701 nt, Artificial Sequence; identical to SEQ ID NO: 69495
  derived and/or modified sequence opt1 from hemagglutinin__InfluenzaA__AFG99611

SEQ ID NO: 69607 - RNA, 1701 nt, Artificial Sequence; identical to SEQ ID NO: 69495
  derived and/or modified sequence opt1 from hemagglutinin__InfluenzaA__AFG99622

SEQ ID NO: 69608 - RNA, 1701 nt, Artificial Sequence; identical to SEQ ID NO: 69495
  derived and/or modified sequence opt1 from hemagglutinin__InfluenzaA__AFG99633

SEQ ID NO: 69609 - RNA, 1701 nt, Artificial Sequence
  derived and/or modified sequence opt1 from hemagglutinin__InfluenzaA__AFG99644
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccggauccuggacggcaagaacugcacccugaucgacgcccuccugggggacccccacugcgacgacuuccagaacaaggagugggaccuguucguggagcgcuccaaggccuacagcaacugcuaccccuacgacgugccggacuacgcgucccuccggagccuggucgccgccuccggcacgcuggaguucaucaacgaggacuucaacuggaccggcguggcccagagcggggaguccuacgcgugcaagcgcggcagcgugaaguccuucuucagccggcucaacuggcugcacgaguccgaguacaaguaccccgcccugaacgucaccaugcccaacaacgggaaguucgacaagcucuacaucuggggcgugcaccaccccagcaccgaccgcgagcagacgucccuguacgugcgggccagcgggcgcgucaccguguccaccaagcggagccagcagaccgugaucccgaacaucggcagccgccccuggguccggggccuguccagccgcaucuccaucuacuggacgaucgugaagcccggggacauccuccugaucaacagcaccggcaaccugaucgcgccccggggguacuucaagauccgcaccggcaaguccagcaucaugcgguccgacgccccgaucgggaccugcagcuccgagugcaucacgcccaacggcagcauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgcggaccucaagagcacccaggccgccaucgaccagaucaacggcaagcugaaccggcugaucgagaagaccaacgagaaguuccaccagaucgagaaggaguucuccgagaucgagggccgcauccagaaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgcggaggacauggggaacggcugcuucaagaucuaccacaagugcgacaacgccugcaucgggagcauccgcaacggcacguacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 69610 - RNA, 1701 nt, Artificial Sequence
  derived and/or modified sequence opt1 from hemagglutinin__InfluenzaA__AFG99655
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccggauccuggacggcaagaacugcacccugaucgacgcccuccugggggacccccacugcgacgacuuccagaacaaggagugggaccuguucguggagcgcuccaaggccuacagcaacugcuaccccuacgacgugccggacuacgcgucccuccggagccuggucgccuccagcggcacgcuggaguucaucaacgaggacuucaacuggaccggcguggcccaguccggggagagcuacgccugcaagcgcggcuccgucaagagcuucuucucccggcucaacuggcugcacgagagcgaguacaaguaccccgcgcugaacgugaccaugcccaacaacgggaaguucgacaagcucuacaucuggggcgugcaccaccccuccaccgaccgcgagcagacgagccuguacgugcgggccuccgggcgcgucaccgugagcaccaagcggagccagcagaccgugaucccgaacaucggcucccgccccuggguccggggccugagcucccgcaucagcaucuacuggacgaucgugaagcccggggacauccuccugaucaacuccaccggcaaccugaucgcgccccggggguacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucagcgagaucgagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagagcggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 69611 - RNA, 1701 nt, Artificial Sequence; identical to SEQ ID NO: 69610
  derived and/or modified sequence opt1 from hemagglutinin__InfluenzaA__AFG99666

SEQ ID NO: 69612 - RNA, 1701 nt, Artificial Sequence; identical to SEQ ID NO: 63346
  derived and/or modified sequence opt1 from hemagglutinin__InfluenzaA__AFG99677

SEQ ID NO: 69613 - RNA, 1701 nt, Artificial Sequence; identical to SEQ ID NO: 69495
  derived and/or modified sequence opt1 from hemagglutinin__InfluenzaA__AFG99688

SEQ ID NO: 69614 - RNA, 1701 nt, Artificial Sequence
  derived and/or modified sequence opt1 from hemagglutinin__InfluenzaA__AFG99701
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaacgccuacuccaacugcuaccccuacgacgugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcgccgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 69615 - RNA, 1701 nt, Artificial Sequence
  derived and/or modified sequence opt1 from hemagglutinin__InfluenzaA__AFG99712
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgaggugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 69616 - RNA, 1701 nt, Artificial Sequence; identical to SEQ ID NO: 69495
  derived and/or modified sequence opt1 from hemagglutinin__InfluenzaA__AFG99723

SEQ ID NO: 69617 - RNA, 1701 nt, Artificial Sequence; identical to SEQ ID NO: 69610
  derived and/or modified sequence opt1 from hemagglutinin__InfluenzaA__AFG99734

SEQ ID NO: 69618 - RNA, 1701 nt, Artificial Sequence
  derived and/or modified sequence opt1 from hemagglutinin__InfluenzaA__AFG99745
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgacuccuacgccugcaagcgcgggagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgagcgcgagcagacgucccuguacauccgggccagcgggcgcgugaccgucagcaccaagcggucccagcagaccgugaucccgaacaucggcagcaagcccugggugcgcggccuguccagccggaucuccaucuacuggacgaucgucaagcccggggacauccuccugaucaacagcaccggcaaccugaucgcgccccgcggguacuucaagauccggaccggcaaguccagcaucaugcgcuccgacgccccgaucgggaccugcagcuccgagugcaucacgcccaacggcagcauccccaacgacaagcccuuccagaacgugaaccggaucaccuacggcgccugcccgcgcuacgugaagcagaacacccucaagcuggccaccgggaugcggaacguccccgagaagcagacgcgcggcaucuucggggccaucgccggcuucaucgagaacggcugggaggggaugguggacggcugguacggguuccggcaccagaacuccgagggcaccgggcaggccgccgaccugaaguccacccaggcggccaucgaccagaucaacggcaagcucaaccgccugaucgagaagaccaacgagaaguuccaccagaucgagaaggaguucuccgagguggagggccggauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgcgagaacgccgaggacauggggaacggcugcuucaagaucuaccacaagugcgacaacgcgugcauggggagcauccggaacggcacguacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 69619 - RNA, 1701 nt, Artificial Sequence; identical to SEQ ID NO: 69495
  derived and/or modified sequence opt1 from hemagglutinin__InfluenzaA__AFG99756

SEQ ID NO: 69620 - RNA, 1701 nt, Artificial Sequence
  derived and/or modified sequence opt1 from hemagglutinin__InfluenzaA__AFG99767
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacgacuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccggcguggcccagagcggggaguccuacgccugcaagcgcggcagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgaccgcgagcagacgucccuguacauccgggccagcggccgcgugaccgucagcaccaagcggucccagcagaccgugaucccgaacaucgggagccgccccugggugcggggccuguccagccgcaucuccaucuacuggacgaucgucaagcccggcgacauccuccugaucaacagcaccgggaaccugaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccugaaguccacccaggcggccaucgaccagaucaacgggaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 69621 - RNA, 1701 nt, Artificial Sequence
  derived and/or modified sequence opt1 from hemagglutinin__InfluenzaA__AFG99778
augaagaccaucaucgcccugagcuacauccucugccugguguucgcccagaagcugcccggcaacgacaacuccaccgcgacgcucugccuggggcaccacgccgucccgaacggcacccuggugaagacccucaccaacgaccagaucgaggugacgaacgccaccgagcugguccagagcuccagcaccgggaagaucugcgacagcccccaccgcauccuggacggcaagaacugcacccucaucgacgcccugcugggggacccccacugcgacggccuccagaacaaggagugggaccuguucguggagcgguccaaggccuacuccaacugcuaccccuacgacgugccggacuacgcgagccugcgcucccucgucgccagcuccggcacgcuggaguucaucaacgaggacuucaacuggaccgggguggcccaggacggcgggagcuacgccugcaagcggggcuccgugaacagcuucuucucccgccugaacuggcuccacaagagcgaguacaaguaccccgcgcugaacgucaccaugcccaacaacgggaagguggacaagcuguacaucuggggcgugcaccaccccuccaccgaccgggaccagacgagccucuacguccgcgccuccggccgggugaccgugagcaccaagcgcagccagcagaccgucaucccgaacaucgggucccggcccugggugcgcggccagagcucccggaucagcaucuacuggacgaucgugaagcccggggacauccugcugaucaacuccaccggcaaccucaucgcgccccgcggcuacuucaagauccggaacggcaagagcuccaucaugcgcagcgacgccccgaucgggaccugcuccagcgagugcaucacccccaacggguccauccccaacgacaagcccuuccagaacgucaaccggaucacguacggcgccugcccgcgcuacgugaagcagaacacccugaagcuggccaccgggaugcggaacgugcccgagaagcagacccgcggcaucuucggcgccaucgccggguucaucgagaacggcugggaggggauggucgacggcugguacggguuccggcaccagaacagcgagggcacgggccaggccgccgaccucaaguccacccaggcggccaucgaccagaucaacgggaagcugaaccgccugaucgagaagaccaacgagaaguuccaccagaucgagaaggaguucagcgagguggagggccggauccaggaccucgagaaguacguggaggacaccaagaucgaccugugguccuacaacgccgagcugcucgucgcccuggagaaccagcacacgaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggcgucgagcucaagagcggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 69622 - RNA, 1701 nt, Artificial Sequence; identical to SEQ ID NO: 69495
  derived and/or modified sequence opt1 from hemagglutinin__InfluenzaA__AFG99789

SEQ ID NO: 69623 - RNA, 1701 nt, Artificial Sequence; identical to SEQ ID NO: 69610
  derived and/or modified sequence opt1 from hemagglutinin__InfluenzaA__AFG99800

SEQ ID NO: 69624 - RNA, 1701 nt, Artificial Sequence
  derived and/or modified sequence opt1 from hemagglutinin__InfluenzaA__AFG99811
augaagaccaucaucgcccugagcuacauccucugccugguguucucccagaagcugcccggcaacgacaacagcaccgccacgcucugccuggggcaccacgcggucccgaacggcacccuggugaagaccaucaccaacgaccagaucgaggugacgaacgccaccgagcucguccagaacuccagcaccgggcgcaucugcgacagcccccaccggauccuggacggcaagaacugcacccugaucgacgcccuccugggggacccccacugcgacgacuuccagaacaaggagugggaccuguucguggagcgcagcaaggccuacuccaacugcuaccccuacgacgugccggacuacgccagccuccggucccuggucgcgagcuccggcacgcuggaguucaucaacgaggacuucaacuggaccggcguggcccagagcggggaguccuacgccugcaagcgcggcagcgugaaguccuucuucagccggcucaacuggcugcacgaguccgaguacaaguaccccgcccugaacgucaccaugcccaacaacgggaaguucgacaagcucuacaucuggggcgugcaccaccccagcaccgaccgcgagcagacgucccuguacgugcgggcgagcgggcgcgucaccgugagcaccaagcggucccagcagaccgugaucccgaacaucggcagccgccccuggguccggggccuguccagccgcaucuccaucuacuggacgaucgugaagcccggggacauccuccugaucaacagcaccggcaaccugaucgcgccccggggguacuucaagauccgcaccggcaaguccagcaucaugcgguccgacgccccgaucgggaccugcagcuccgagugcaucacgcccaacggcagcauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggccgcgaucgaccagaucaacggcaagcucaaccggcugaucgagaagaccaacgagaaguuccaccagaucgagaaggaguucuccgagaucgagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgccugcaucgggagcauccgcaacggcacguacgaccacgacguguaccgggacgaggcgcugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 69625 - RNA, 1701 nt, Artificial Sequence; identical to SEQ ID NO: 69495
  derived and/or modified sequence opt1 from hemagglutinin__InfluenzaA__AFG99822

SEQ ID NO: 69626 - RNA, 1701 nt, Artificial Sequence; identical to SEQ ID NO: 69495
  derived and/or modified sequence opt1 from hemagglutinin__InfluenzaA__AFG99833

SEQ ID NO: 69627 - RNA, 1701 nt, Artificial Sequence; identical to SEQ ID NO: 69495
  derived and/or modified sequence opt1 from hemagglutinin__InfluenzaA__AFG99844

SEQ ID NO: 69628 - RNA, 1701 nt, Artificial Sequence
  derived and/or modified sequence opt1 from hemagglutinin__InfluenzaA__AFG99855
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacgaguccgacuacaaguaccccgcgcugaacgucaccaugcccaacaacggcaaguucgacaagcucuacaucuggggcgugcaccaccccagcacggaccgcgagcagaccucccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgggaagcagacccggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcucaaccggcugaucgagaagacgaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcugaaguccggguacaaggacuggauccucuggaucagcuucgccaucagcugcuuccugcugugcgucgugcuccugggcuucaucaugugggccugccagaaggggaacauccggugcaacaucugcaucuga

SEQ ID NO: 69629 - RNA, 1701 nt, Artificial Sequence; identical to SEQ ID NO: 69495
  derived and/or modified sequence opt1 from hemagglutinin__InfluenzaA__AFG99866

SEQ ID NO: 69630 - RNA, 1701 nt, Artificial Sequence; identical to SEQ ID NO: 69495
  derived and/or modified sequence opt1 from hemagglutinin__InfluenzaA__AFG99877

SEQ ID NO: 69631 - RNA, 1701 nt, Artificial Sequence
  derived and/or modified sequence opt1 from hemagglutinin__InfluenzaA__AFG99888
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgaguccuacgccugcaagcgcgggagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgaccgcgagcagacgucccuguacauccgggccagcgggcgcgugaccgucagcaccaagcggucccagcagaccgugaucccgaacaucggcagccgccccugggugcggggccuguccagccgcaucuccaucuacuggacgaucgucaagcccggggacauccuccugaucaacagcaccggcaaccugaucgcgccccggggguacuucaagauccgcaccggcaaguccagcaucaugcgguccgacgccccgaucgggaccugcaacagcgagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacaaccacgacguguaccgggacgaggcccugaacaaccgcuuccagaucaagggggucgagcugaaguccggcuacaaggacuggauccucuggaucuccuucgccaucagcugcuuccugcugugcgugguccuccugggcuucaucaugugggccugccagaaggggaacauccggugcaacaucugcaucuga

SEQ ID NO: 69632 - RNA, 1701 nt, Artificial Sequence; identical to SEQ ID NO: 69495
  derived and/or modified sequence opt1 from hemagglutinin__InfluenzaA__AFG99899

SEQ ID NO: 69633 - RNA, 1701 nt, Artificial Sequence; identical to SEQ ID NO: 69495
  derived and/or modified sequence opt1 from hemagglutinin__InfluenzaA__AFG99910

SEQ ID NO: 69634 - RNA, 1701 nt, Artificial Sequence; identical to SEQ ID NO: 69495
  derived and/or modified sequence opt1 from hemagglutinin__InfluenzaA__AFG99921

SEQ ID NO: 69635 - RNA, 1701 nt, Artificial Sequence
  derived and/or modified sequence opt1 from hemagglutinin__InfluenzaA__AFG99932
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgaguccuacgccugcaagcgcgggagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgaccgcgagcagacgucccuguacauccgggccagcgggcgcgugaccgucagcaccaagcggucccagcagaccgugaucccgaacaucggcagccgccccugggugcggggccuguccagccgcaucuccaucuacuggacgaucgucaagcccggggacauccuccugaucaacagcaccggcaaccugaucgcgccccggggguacuucaagauccgcaccggcaaguccagcaucaugcgguccgacgccccgaucgggaccugcagcuccgagugcaucacgcccaacggcagcauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucgaccagaucaacggcaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggagcauccgcaacggcacguacgaccacgacguguaccgggacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 69636 - RNA, 1701 nt, Artificial Sequence; identical to SEQ ID NO: 69495
  derived and/or modified sequence opt1 from hemagglutinin__InfluenzaA__AFG99943

SEQ ID NO: 69637 - RNA, 1701 nt, Artificial Sequence
  derived and/or modified sequence opt1 from hemagglutinin__InfluenzaA__AFG99954
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgacuccuacgccugcaagcgcgggagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgagcgcgagcagacgucccuguacauccgggccagcgggcgcgugaccgucagcaccaagcggucccagcagaccgugaucccgaacaucggcuucaagcccugggugcgcggccugagcucccggaucagcaucuacuggacgaucgucaagcccggggacauccuccugaucaacuccaccggcaaccugaucgcgccccgcggguacuucaagauccggaccggcaagagcuccaucaugcgcagcgacgccccgaucgggaccugcuccagcgagugcaucacgcccaacggcuccauccccaacgacaagcccuuccagaacgugaaccggaucaccuacggcgccugcccgcgcuacgugaagcagaacacccucaagcuggccaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucgaccagaucaacggcaagcucaaccgccugaucgagaagaccaacgagaaguuccaccagaucgagaaggaguucagcgagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcacguacgaccacgacguguaccgcgacgaggcccugaacaaccgguuccagaucaagggggucgagcugaaguccggcuacaaggacuggauccucuggaucuccuucgccaucagcugcuuccugcugugcgugguccuccugggcuucaucaugugggccugccagaaggggaacauccgcugcaacaucugcaucuga

SEQ ID NO: 69638 - RNA, 1701 nt, Artificial Sequence
  derived and/or modified sequence opt1 from hemagglutinin__InfluenzaA__AFG99965
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccggauccuggacggcaagaacugcacccugaucgacgcccuccugggggacccccacugcgacggcuuccagaacaaggagugggaccuguucgucgagcgcagcaaggcguacuccaacugcuaccccuacgacgugccggacuacgccagccuccggucccugguggccagcuccggcacgcuggaguucaccaacgaggacuucaacuggaccggggucgcccagagcggcgaguccuacgcgugcaagcgcgggagcgugaaguccuucuucagccggcucaacuggcugcacgaguccgacuacaaguaccccgcccugaacgugaccaugcccaacaacggcaaguucgacaagcucuacaucuggggcguccaccaccccagcacggaccgcgagcagaccucccuguacgugcgggccagcgggcgcgugaccgucagcaccaagcggucccagcagacggugaucccgaacaucggcagccgccccugggugcgggggcuguccagccgcaucuccaucuacuggaccaucgucaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgugaagcagaacacccucaagcuggccacgggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacccaggccgccaucgaccagaucaacggcaagcucaaccggcugaucgagaagacgaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 69639 - RNA, 1701 nt, Artificial Sequence; identical to SEQ ID NO: 69495
  derived and/or modified sequence opt1 from hemagglutinin__InfluenzaA__AFG99976

SEQ ID NO: 69640 - RNA, 1701 nt, Artificial Sequence
  derived and/or modified sequence opt1 from hemagglutinin__InfluenzaA__AFG99987
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagaacggcgacagcuacgccugcaagcgcggguccgugaaguccuucuucucccggcucaacuggcugcacgagagcgaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucagcaccaagcggagccagcagaccgugaucccgaacaucggcucccgccccugggugcggggccugagcucccgcaucagcaucuacuggacgaucgucaagcccggggacauccuccugaucaacuccaccggcaaccugaucgcgccccggggguacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagagcggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 69641 - RNA, 1701 nt, Artificial Sequence
  derived and/or modified sequence opt1 from hemagglutinin__InfluenzaA__AFG99998
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgccccgaucggcaacugcuccagcgagugcaucacccccaacggguccauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacagcgagggcacgggccaggccgccgaccucaaguccacccaggcggccaucgaccagaucaacgggaagcugaaccgccugaucgagaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 69642 - RNA, 1701 nt, Artificial Sequence; identical to SEQ ID NO: 69610
  derived and/or modified sequence opt1 from hemagglutinin__InfluenzaA__AFH00021

SEQ ID NO: 69643 - RNA, 1701 nt, Artificial Sequence
  derived and/or modified sequence opt1 from hemagglutinin__InfluenzaA__AFH00032
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcgacagcccccaccgcauccuggacggcaagaacugcacccugaucgacgcccuccugggggacccccacugcgacgacuuccagaacaaggagugggaccuguucguggagcggagcaaggccuacuccaacugcuaccccuacgacgugccggacuacgcgagccuccgcucccuggucgccagcuccggcacgcuggaguucaucaacgaggacuucaacuggaccggcguggcccagagcggggacuccuacgccugcaagcggggcagcgugaaguccuucuucagccgccucaacuggcugcacgaguccgaguacaaguaccccgcgcugaacgucaccaugcccaacaacgacaaguucgacaagcucuacaucuggggcgugcaccaccccagcaccgaccgggagcagacgucccuguacauccgcgccagcggccgggugaccgucagcaccaagcgcucccagcagaccgugaucccgaacaucgggagccggcccugggugcgcggccuguccagccggaucuccaucuacuggacgaucgucaagcccggcgacauccuccugaucaacagcaccgggaaccugaucgcgccccgcggcuacuucaagauccggaccgggaaguccagcaucaugcgcuccgacgccccgaucgggaccugcagcuccgagugcaucacgcccaacggcagcauccccaacgacaagcccuuccagaacgugaaccggaucaccuacggggccugcccgcgcuacgugaagcagaacacccucaagcuggccaccggcaugcggaacguccccgagaagcagacgcgcgggaucuucggcgccaucgccggguucaucgagaacggcugggagggcaugguggacgggugguacggcuuccggcaccagaacuccgaggggaccggccaggccgccgaccugaaguccacccaggcggccaucgaccagaucaacgggaagcucaacaagcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccggaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 69644 - RNA, 1701 nt, Artificial Sequence
  derived and/or modified sequence opt1 from hemagglutinin__InfluenzaA__AFH00043
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcgacagcccccaccgcauccuggacggcaagaacugcacccugaucgacgcccuccugggggacccccacugcgacgacuuccagaacaaggagugggaccuguucguggagcggagcaaggccuacuccaacugcuaccccuacgacgugccggacuacgcgagccuccgcucccuggucgccagcuccggcacgcuggaguucaucaacgaggacuucaacuggaccggcguggcccagagcggggacuccuacgccugcaagcggggcagcgugaaguccuucuucagccgccucaacuggcugcacgaguccgaguacaaguaccccgcgcugaacgucaccaugcccaacaacgacaaguucgacaagcucuacaucuggggcgugcaccaccccagcaccgaccgggagcagacgucccuguacauccgcgccagcgggcgggugaccgucagcaccaagcgcucccagcagaccgugaucccgaacaucgggagccggcccugggugcgcggccuguccagccggaucuccaucuacuggacgaucgucaagcccggcgacauccuccugaucaacagcaccgggaaccugaucgcgccccgcggcuacuucaagauccggaccgggaaguccagcaucaugcgcuccgacgccaccaucggcacgugcagcuccgagugcaucaccccgaacggcagcauccccaacgacaagcccuuccagaacgugaaccggaucaccuacggggccugcccccgcuacgugaagcagaacacccucaagcuggccacgggcaugcggaacgucccggagaagcagacccgcgggaucuucggcgccaucgccggguucaucgagaacggcugggagggcaugguggacgggugguacggcuuccggcaccagaacuccgaggggaccggccaggccgccgaccugaaguccacccaggcggccaucgaccagaucaacgggaagcucaacaagcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcggaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 69645 - RNA, 1701 nt, Artificial Sequence
  derived and/or modified sequence opt1 from hemagglutinin__InfluenzaA__AFH00054
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagaacggcgacagcuacgccugcaagcgcggguccgugaaguccuucuucucccggcucaacuggcugcacgagagcgaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucagcaccaagcggagccagcagaccgugaucccgaacaucggcucccgccccugggugcggggccugagcucccgcaucagcaucuacuggacgaucgucaagcccggggacauccuccugaucaacuccaccggcaaccugaucgcgccccggggguacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccacaucaagggggucgagcucaagagcggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 69646 - RNA, 1701 nt, Artificial Sequence
  derived and/or modified sequence opt1 from hemagglutinin__InfluenzaA__AFH00065
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugaucccgaacaucgggucccggcccuggguccgcggccagcccagccggaucuccaucuacuggacgaucgugaagcccggggacauccuccugaucaacagcaccggcaaccugaucgccccgcgcggcuacuucaagauccggaacgggaaguccagcaucaugcgcuccgacgcccccaucggcaacugcagcuccgagugcaucacccccaacgggagcauccccaacgacaagccguuccagaacgugaaccggaucaccuacggcgccugcccccgcuacgucaagcagaacacgcucaagcuggcgaccgggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccugaaguccacgcaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 69647 - RNA, 1701 nt, Artificial Sequence
  derived and/or modified sequence opt1 from hemagglutinin__InfluenzaA__AFH00076
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcgacagcccccaccgcauccuggacggcaagaacugcacccugaucgacgcccuccugggggacccccacugcgacgacuuccagaacaaggagugggaccuguucguggagcggagcaaggccuacuccaacugcuaccccuacgacgugccggacuacgcgagccuccgcucccuggucgccagcuccggcacgcuggaguucaucaacgaggacuucaacuggaccggcguggcccagagcggggacuccuacgccugcaagcggggcagcgugaaguccuucuucagccgccucaacuggcugcacgaguccgaguacaaguaccccgcgcugaacgucaccaugcccaacaacgacaaguucgacaagcucuacaucuggggcgugcaccaccccagcaccgaccgggagcagacgucccuguacauccgcgccagcggccgggugaccgucagcaccaagcgcucccagcagaccgugaucccgaacaucgggagccggcccugggugcgcggccuguccagccggaucuccaucuacuggacgaucgucaagcccggcgacauccuccugaucaacagcaccgggaaccugaucgcgccccgcggcuacuucaagauccggaccgggaaguccagcaucaugcgcuccgacgccccgaucgggaccugcaacagcgagugcaucacgcccaacggcuccauccccaacgacaagcccuuccagaacgugaaccggaucaccuacggggccugcccgcgcuacgugaagcagaacacccucaagcuggccaccggcaugcggaacguccccgagaagcagacgcgcgggaucuucggcgccaucgccggguucaucgagaacggcugggagggcaugguggacgggugguacggcuuccggcaccagaacagcgaggggaccggccaggccgccgaccugaaguccacccaggcggccaucgaccagaucaacgggaagcucaaccgccugaucgagaagaccaacgagaaguuccaccagaucgagaaggaguucagcgagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcugaaguccggguacaaggacuggauccucuggaucuccuucgccaucagcugcuuccugcugugcgugguccuccugggcuucaucaugugggccugccagaagggcaacauccgcugcaacaucugcaucuga

SEQ ID NO: 69648 - RNA, 1701 nt, Artificial Sequence
  derived and/or modified sequence opt1 from hemagglutinin__InfluenzaA__AFH00087
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcgaggccuacuccagcugcuaccccuacgacgugccggacuacgcgucccuccggagccuggucgccuccagcggcacgcuggaguucaucaacgaggacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccaccccuccaccgacagcgaccagacgucccuguacgugcgcgccagcgggcgggucaccgugagcaccaagcgcucccagcagaccgugaucccgaacaucggcagccggcccuggguccgcgggcaguccagccggaucggcaucuacuggacgaucgugaagcccggggacauccuccugaucaacuccaccggcaaccugaucgcgccccgcggcuacuucaagauccggaacgggaaguccuccaucaugcgcagcgacgccccgaucggcaacugcuccagcgagugcaucacccccaacggguccauccccaacgacaagcccuuccagaacgugaacaagaucaccuacggcgccugcccgcgguacgucaagcagaacacgcucaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccugaaguccacgcaggcggccaucgaccagaucaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 69649 - RNA, 1701 nt, Artificial Sequence
  derived and/or modified sequence opt1 from hemagglutinin__InfluenzaA__AFH00098
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugaucccgaacaucgggucccggcccuggguccgcggccuccccagccggaucuccaucuacuggacgaucgugaagcccggggacauccugcugaucaacagcaccggcaaccucaucgccccgcgcggcuacuucaagauccggaacgggaaguccagcaucaugcgcuccgacgcccccaucggcaacugcagcuccgagugcaucacccccaacgggagcauccccaacgacaagccguuccagaacgugaaccggaucaccuacggcgccugcccccgcuacgucaagcagaacacgcugaagcuggcgaccgggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccucaagagcacgcaggcggccaucgaccagaucaacgggaagcugaaccgccugaucgagaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 69650 - RNA, 1701 nt, Artificial Sequence
  derived and/or modified sequence opt1 from hemagglutinin__InfluenzaA__AFH00109
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacacgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccaccccagcaccgacuccgaccagaccagccuguacgugcgcgcguccgggcgggucaccgugagcaccaagcgcagccagcagacggugaucccgaacaucggcuuccggcccuggguccgcgggcucuccagccggaucuccaucuacuggaccaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucacguacggggccugcccgcgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggacgggccaggccgccgaccucaagagcacccaggccgcgaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacacgaucgaccugaccgacuccgagaugaacaagcuguucgagcgcacccgcaagcagcuccgggagaacgccgaggacauggggaacggcugcuucaagaucuaccacaagugcgacaacgccugcaucgggagcauccgcaacggcaccuacgaccacgacgucuaccgggacgaggcgcugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 69651 - RNA, 1701 nt, Artificial Sequence
  derived and/or modified sequence opt1 from hemagglutinin__InfluenzaA__AFH00120
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaccaugugggccugccagaaggggaacauccggugcaacaucugcaucuga

SEQ ID NO: 69652 - RNA, 1701 nt, Artificial Sequence; identical to SEQ ID NO: 69506
  derived and/or modified sequence opt1 from hemagglutinin__InfluenzaA__AFH00131

SEQ ID NO: 69653 - RNA, 1701 nt, Artificial Sequence
  derived and/or modified sequence opt1 from hemagglutinin__InfluenzaA__AFH00153
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacauccgcgccuccgggcgggugaccgucagcaccaagcgcagccagcagaccgugaucccgaacaucggcucccggcccugggugcgcgggcucagcucccggaucagcaucuacuggacgaucgucaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgugaagcagaacacgcugaagcuggccaccggcaugcggaacguccccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcgugguccugcugggguucaucaugugggccugccagaagggcaacauccggugcaacaucugcaucuga

SEQ ID NO: 69654 - RNA, 1701 nt, Artificial Sequence
  derived and/or modified sequence opt1 from hemagglutinin__InfluenzaA__AFH00164
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugauggacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagaacggcgacagcuacgccugcaagcgcggguccgugaaguccuucuucucccggcucaacuggcugcacgagagcgaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucagcaccaagcggagccagcagaccgugaucccgaacaucggcucccgccccugggugcggggccugagcucccgcaucagcaucuacuggacgaucgucaagcccggggacauccuccugaucaacuccaccggcaaccugaucgcgccccggggguacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucaaccggcugaucgagaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacauggggaacggcugcuucaagaucuaccacaagugcgacaacgcgugcaucggguccauccgcaacggcacguacgaccacgacguguaccgggacgaggcccugaacaaccgcuuccagaucaagggggucgagcucaagagcggcuacaaggacuggauccuguggaucuccuucgccaucagcugcuuccugcugugcgugguccuccugggcuucaucaugugggccugccagaaggggaacauccggugcaacaucugcaucuga

SEQ ID NO: 69655 - RNA, 1701 nt, Artificial Sequence
  derived and/or modified sequence opt1 from hemagglutinin__InfluenzaA__AFH00175
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgucaagagcuucuucucccggcucaacuggcugcacaagcuggaguacaaguaccccgcgcucaacgugaccaugcccaacaacggcaaguucgacaagcuguacaucuggggcgugcaccaccccagcaccgacuccgaccagacgagccuguacgugcgcgccuccgggcgggucaccgugagcaccaagaagucccagcagaccgugaucccgaacaucggcucccgccccuggguccgggggcagagcucccgcaucagcaucuacuggacgaucgugaagcccggcgacauccuccugaucaacuccaccgggaaccugaucgcgccccggggcuacuucaagauccgcaacggcaagagcuccaucaugcggagcgacgccccgaucgggaacugcuccagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugguggacgggugguacggcuuccgccaccagaacagcgaggggaccggccaggccgccgaccugaaguccacgcaggcggccaucgaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 69656 - RNA, 1701 nt, Artificial Sequence
  derived and/or modified sequence opt1 from hemagglutinin__InfluenzaA__AFH00186
augaagaccaucaucgcccugagccacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccagagcucccggaucagcaucuacuggaccaucgugaagcccggggacauccuccugaucuccagcaccggcaaccugaucgcgccccgcggcuacuucaagauccggaacgggaaguccagcaucaugcgcuccgacgugccgaucggcaacugcagcuccgagugcaucacccccaacgggagcauccccaacgacaagcccuuccagaacgucaaccggaucacguacggcgccugcccgcgcuacgugaagcagaacacccucaagcuggccaccgggaugcggaacgugcccgagaagcagacccgcggcaucuucggcgccaucgccggguucaucgagaacggcugggaggggauggucgacggcugguacggguuccggcaccagaacuccgagggcacgggccaggccgccgaccugaaguccacccaggccgcgaucgaccagaucaacgggaagcucaaccgccugaucgagaagaccaacgagaaguuccaccagaucgagaaggaguucuccgagguggagggccggauccaggaccuggagaaguacguggaggacaccaagaucgaccucuggagcuacaacgccgagcugaucgucgcccuggagaaccagcacacgaucgaccucaccgacuccgagaugaacaagcuguucgagaagacccgcaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaagggcgucgagcugaaguccggguacaaggacuggauccuguggaucagcuucgccaucagcugcuuccuccugugcguggugcugcucggcuucaucaugugggccugccagaaggggaacauccgcugcaacaucugcaucuga

SEQ ID NO: 69657 - RNA, 1701 nt, Artificial Sequence
  derived and/or modified sequence opt1 from hemagglutinin__InfluenzaA__AFH00197
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacacgugcaagcgcggcuccgugaacagcuucuucucccggcucaacuggcugcacaagcuggaguacaaguaccccgcccucaacgucaccaugcccaacaacgggaaguucgacaagcuguacaucuggggcgugcaccaccccagcaccgacuccgaccagaccagccuguacgugcgcgcguccggccgggucaccgugagcaccaagaucagccagcagacggugaucccgaacaucgggucccgccccuggguccggggccucagcucccgcaucagcaucuacuggaccaucgugaagcccggggacauccugcugaucaacuccaccggcaaccucaucgcgccccggggcuacuucaagauccgcaacgggaaguccuccaucaugcggagcgacgccccgaucggcaacugcuccagcgagugcaucacccccaacggguccauccccaacgacaagcccuuccagaacgugaaccgcaucacguacggcgccugcccgcgguacgucaagcagaacacccugaagcuggccaccgggaugcgcaacgugcccgagaagcagacccggggcaucuucggcgccaucgccggguucaucgagaacggcugggaggggaugguggacggcugguacggguuccgccaccagaacagcgagggcacgggccaggccgccgaccucaaguccacccaggccgcgaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagcggacccgcaagcagcuccgcgagaacgccgaggacauggggaacggcugcuucaagaucuaccacaagugcgacaacgccugcaucggguccauccggaacggcaccuacgaccacgacgucuaccgcgacgaggcgcugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 69658 - RNA, 1701 nt, Artificial Sequence
  derived and/or modified sequence opt1 from hemagglutinin__InfluenzaA__AFH00208
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagaacggcgacagcuacgccugcaagcgcggguccgugaaguccuucuucucccggcucaacuggcugcacgagagcgaguacaaguaccccgcgcugaacgucaccaugcccaacaacgacaaguucgacaagcucuacaucuggggcgugcaccaccccuccaccgaccgcgagcagacgagccuguacauccgggccuccgggcgcgugaccgucagcaccaagcggagccagcagaccgugaucccgaacaucggcucccgccccugggugcggggccugagcucccgcaucagcaucuacuggacgaucgucaagcccggggacauccuccugaucaacuccaccggcaaccugaucgcgccccggggguacuucaagauccgcaccggcaagagcuccgugaugcggagcgacgccccgaucgggaccugcuccagcgagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucgaccagaucaacggcaagcucagccggcugaucgagaagaccaacgagaaguuccaccagaucgagaaggaguucuccgaggucgagggccgcauccaggaccuggagaaguacguggaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggcuucaucaugugggccugccagaaggggaacauccggugcaacaucugcaucuga

SEQ ID NO: 69659 - RNA, 1701 nt, Artificial Sequence
  derived and/or modified sequence opt1 from hemagglutinin__InfluenzaA__AFH00219
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcacggacuccgaccagaccagccuguacgugcgcgccuccggccgggucaccgugagcaccaagcgcagccagcagacggugaccccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgccccgaucggcacgugcuccagcgagugcaucacccccaacggguccauccccaacgacaagcccuuccagaacgugaaccggaucaccuacggcgccugcccgcgcuacgucaagcagaacacccugaagcuggccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacccaggcggccaucgaccagaucaacgggaagcugaaccgccugaucgacaagacgaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugaccgacagcgagaugaacaagcuguucgagaagacgcgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 69660 - RNA, 1701 nt, Artificial Sequence
  derived and/or modified sequence opt1 from hemagglutinin__InfluenzaA__AFH00230
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaaguccuucuucucccggcucaacuggcugcacaagcuggaguacaaguaccccgcgcucaacgucaccaugcccaacaacggcaaguucgacaagcuguacaucuggggcgugcaccaccccagcaccaacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 69661 - RNA, 1701 nt, Artificial Sequence; identical to SEQ ID NO: 62032
  derived and/or modified sequence opt1 from hemagglutinin__InfluenzaA__AFH00241

SEQ ID NO: 69662 - RNA, 1701 nt, Artificial Sequence
  derived and/or modified sequence opt1 from hemagglutinin__InfluenzaA__AFH00252
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacgacuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccggcguggcccagagcggggacuccuacgccugcaagcgcggcagcgugaaguccuucuucagccggcucaacuggcugcacgaguccgaguacaaguaccccgcgcugaacgucaccaugcccaacaacgacaaguucgacaagcucuacaucuggggcgugcaccaccccagcaccgaccgcgagcagacgucccuguacauccgggccagcggccgcgugaccgucagcaccaagcggucccagcagaccgugaucccgaacaucgggagccgccccugggugcggggccuguccagccgcaucuccaucuacuggacgaucgucaagcccggcgacauccuccugaucaacagcaccgggaaccugaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccugaaguccacccaggcggccaucgaccagaucaacgggaagcucaaccggcugaucgagaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 69663 - RNA, 1701 nt, Artificial Sequence
  derived and/or modified sequence opt1 from hemagglutinin__InfluenzaA__AFH00263
augaagaccaucaucgcccugagcuacauccuccaccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcacggacuccgugcagaccagccuguacguccgcgccuccggcaaggugaccgugagcaccaagcggagccagcagacggucaccccgaacaucggguccaagcccugggugcgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgccccgaucggcacgugcuccagcgagugcaucacccccaacggguccauccccaacgacaagcccuuccagaacgucaaccggaucaccuacggcgccugcccgcgcuacgugaagcagaacacccugaagcuggccacggggaugcggaacgugcccgagaagcagacccgcggcaucuucggcgccaucgccggguucaucgagaacggcugggaggggauggucgacggcugguacggguuccggcaccagaacagcgagggcaccggccaggccgccgaccucaaguccacccaggcggccaucgaccagaucaacgggaagcugaaccgccugaucgagaagacgaacgagaaguuccaccagaucgagaaggaguucagcgagguggagggccggauccaggaccucgagaaguacguggaggacaccaagaucgaccugugguccuacaacgccgagcugcucgucgcccuggagaaccagcacaccaucgaccugaccgacagcgagaugaacaagcuguucgagaagacgcgcaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggcgucgagcucaagagcggguacaaggacuggauccuguggaucuccuucgccaucagcugcuuccugcucugcguggugcugcugggcuucaucaugugggccugccagaaggggaacauccgcugcaacaucugcaucuga

SEQ ID NO: 69664 - RNA, 1701 nt, Artificial Sequence
  derived and/or modified sequence opt1 from hemagglutinin__InfluenzaA__AFH00274
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagcggcaucuccaucuacuggacgaucgugaagcccggggacauccugcugaucaacagcaccggcaaccucaucgcgccccggggcuacuucaagauccgcaacgggaaguccagcaucaugcgguccgacgccccgaucggcaacugcagcuccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggcggccaucgaccagaucaacgggaagcugaaccggcugaucgagaagaccaacgagaaguuccaccagaucgagaaggaguucuccgaggucgagggccgcauccaggaccucgagaaguacguggaggacaccaagaucgaccuguggagcuacaacgccgggcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 69665 - RNA, 1701 nt, Artificial Sequence
  derived and/or modified sequence opt1 from hemagglutinin__InfluenzaA__AFH00285
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcggcagcccccaccggauccuggacgggaagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaucaacgaggacuucaacuggaccggcguggcccaggacgggggcagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugacgccgaacaucggcucccggcccuggguccgcgggcagagcucccggaucagcaucuacuggaccaucgugaagcccggcgacauccuccugaucaacuccaccggcaaccugaucgcgccccgcggguacuucaagauccggaacggcaagagcuccaucaugcgcagcgacgccccgaucgggaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcggcaucuucggggccaucgccggcuucaucgagaacgggugggagggcaugguggacgggugguacggcuuccggcaccagaacagcgagggcacggggcaggccgccgaccugaaguccacccaggcggccaucgaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagaagacccgcaagcagcuccgcgagaacgccgaggacaugggcaacgggugcuucaagaucuaccacaagugcgacaacgcgugcaucggcuccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcgucgugcuccugggguucaucaugugggccugccagaagggcaacauccgcugcaacaucugcaucuga

SEQ ID NO: 69666 - RNA, 1701 nt, Artificial Sequence
  derived and/or modified sequence opt1 from hemagglutinin__InfluenzaA__AFH00296
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaaccucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaccagcugcuuccuccugugcgucgugcugcucggcuucaucaugugggccugccagaaggggaacauccggugcaacaucugcaucuga

SEQ ID NO: 69667 - RNA, 1701 nt, Artificial Sequence
  derived and/or modified sequence opt1 from hemagglutinin__InfluenzaA__AFH00307
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccagagcucccggaucagcaucuacuggaccaucgugaagcccggggacauccuccugaucaacuccaccggcaaccugaucgcgccccgcggcuacuucaagauccggaacgggaaguccuccaucaugcgcagcgacgccccgaucggcaacugcuccagcgagugcaucacccccaacggguccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggcgccaucgccggguucaucgagaacggcugggaggggaugguggacggcugguacggguuccggcaccagaacagcgagggcacgggccaggccgccgaccugaaguccacccaggcggccaucgaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 69668 - RNA, 1701 nt, Artificial Sequence; identical to SEQ ID NO: 69667
  derived and/or modified sequence opt1 from hemagglutinin__InfluenzaA__AFH00318

SEQ ID NO: 69669 - RNA, 1701 nt, Artificial Sequence
  derived and/or modified sequence opt1 from hemagglutinin__InfluenzaA__AFH00329
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucccaccaccggauccuggacggcaagaacugcacccugaucgacgcccuccugggggacccccacugcgacggcuuccagaacaaggagugggaccuguucguggagcgcagcaaggccuacuccaacugcuaccccuacgacgugcccgacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguacccggcgcucaacgucaccaugcccaacaacggcaaguucgacaagcuguacaucuggggcgugcaccaccccagcaccgacuccgaccagacgagcaucuacgugcgcgccuccgggcgggucaccgugagcaccaagcgcagccagcagaccgugauccccaacaucggcucccggccguggguccgcgggaucagcucccggaucagcaucuacuggacgaucgugaagcccggcgacauccugcucaucaacuccaccgggaaccugaucgcgccccgcggcuacuucaagauccggaacggcaagagcuccaucaugcgcagcgacgcccccaucgggaacugcaacuccgagugcaucaccccgaacggcagcauccccaacgacaagcccuuccagaacgugaaccggaucaccuacggggccugcccccgcuacgucaagcagaacacgcugaagcucgccaccggcaugcggaacgugccggagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucacggacuccgagaugaacaagcuguucgagcgcacccgcaagcagcugcgggagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaccuccugcuuccuccugugcgucgugcugcucggguucaucaugugggccugccagaagggcaacauccggugcaacaucugcaucuga

SEQ ID NO: 69670 - RNA, 1701 nt, Artificial Sequence
  derived and/or modified sequence opt1 from hemagglutinin__InfluenzaA__AFH00340
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucagcuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacauccccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacgucgaggacaccaagaucgaccugugguccuacaacgccggccugcucguggcccuggagaaccagcacaccaucgaccugacggacagcgagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggcgucgagcucaagagcggguacaaggacuggauccuguggaucuccuucgccaucagcugcuuccugcucugcgugguccugcugggcuucaucaugugggccugccagaaggggaacauccggugcaacaucugcaucuga

SEQ ID NO: 69671 - RNA, 1701 nt, Artificial Sequence
  derived and/or modified sequence opt1 from hemagglutinin__InfluenzaA__AFH00351
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgucaagagcuucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgggaacugcaacuccgagugcaucacccccgacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcugaucgagaagaccaacaagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 69672 - RNA, 1701 nt, Artificial Sequence
  derived and/or modified sequence opt1 from hemagglutinin__InfluenzaA__AFH00362
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgucaagagcuucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccacguccugcuuccugcugugcgucgugcuccugggcuucaucaugugggccugccagaaggggaacauccgcugcaacaucugcaucuga

SEQ ID NO: 69673 - RNA, 1701 nt, Artificial Sequence
  derived and/or modified sequence opt1 from hemagglutinin__InfluenzaA__AFH00384
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaucgggaaccugaucgcgccccggggcuacuucaagauccgcaacggcaagagcuccaucaugcggagcgacgccccgaucgggaacugcaacuccgagugcaucacccccaacggcagcauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccggccugcugguggcccucgagaaccagcacaccaucgaccugacggacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcugaaguccggguacaaggacuggauccucuggaucagcuucgccaucuccugcuuccugcugugcgucgugcuccugggcuucaucaugugggccugccagaaggggaacauccgcugcaacaucugcaucuga

SEQ ID NO: 69674 - RNA, 1701 nt, Artificial Sequence
  derived and/or modified sequence opt1 from hemagglutinin__InfluenzaA__AFH00395
augaaggccaucaucgcccugagcuacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggcguacuccaacugcuaccccuacgacgugccggacuacgccagccuccggucccuggucgccagcuccggcacccuggaguucacgaaggagggguucaacuggaccggcguggcccaggacgggaaguccuacgcgugcaagcgcggcuccgugaacggguucuucagccggcucaacuggcugcacaagcuggaguacaaguaccccgcccucaacgucaccaugcccaacaacgacaaguucgacaagcuguacaucuggggcgugcaccaccccuccaccgacagcgaccagacgucccuguacgugcaggccagcggccgcgucaccguguccaccaagcggagccagcagaccgugaucccgaacaucgggagccgccccuggguccggggcaucuccagccgcaucuccaucuacuggacgaucgugaagcccggggacauccuccugaucaagagcaccggcaaccugaucgcgccccggggcuacuucaagauccgcaacgggaaguccagcaucaugcgguccgacgccccgaucggcaacugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgcggaccugaaguccacgcaggccgccaucgaccagaucaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgcggaggacauggggaacggcugcuucaagaucuaccacaagugcgacaacgccugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 69675 - RNA, 1701 nt, Artificial Sequence
  derived and/or modified sequence opt1 from hemagglutinin__InfluenzaA__AFH00417
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgucaagagcuucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 69676 - RNA, 1701 nt, Artificial Sequence; identical to SEQ ID NO: 61996
  derived and/or modified sequence opt1 from hemagglutinin__InfluenzaA__AFH00428

SEQ ID NO: 69677 - RNA, 1701 nt, Artificial Sequence
  derived and/or modified sequence opt1 from hemagglutinin__InfluenzaA__AFH00439
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucagcgagguggaggggcgcauccaggaccuggagaaguacguggaggacacgaagaucgaccucugguccuacaacgccgagcugcuggucgcccucgagaaccagcacaccaucgaccugaccgacagcgagauguccaagcuguucgagcggacccgcaagcagcuccgcgagaacgccgaggacaugggcaacgggugcuucaagaucuaccacaagugcgacaacgcgugcaucggcagcauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 69678 - RNA, 1701 nt, Artificial Sequence
  derived and/or modified sequence opt1 from hemagglutinin__InfluenzaA__AFH00450
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacggcccccaccggaucaucgacgggaagaacugcacccugaucgacgcccugcucggcgacccccacugcgacggcuuccagaacaaggagugggaccuguucguggagcgcuccaaggccuacagcaacugcuaccccuacgacgugccggacuacgcgucccugcggagccucgucgccuccagcgggacgcuggaguucaccaacgaguccuucaacuggaccggcguggcccagaacgggaccagcuacgccugcaagcgcggcuccgucaagagcuucuucucccggcugaacuggcuccacaagcuggaguacaaguaccccgcgcugaacgugacgaugcccaacaacgacaaguucgacaagcucuacaucuggggcgugcaccaccccagcaccgacuccgaccagaccagccuguacgugcaguccagcgggcgcgucaccgugagcacgaagcggucccagcagaccgugaucccgaacaucggcagccgccccuggguccgcgggguguccagccggaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgacaacugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggaugaucgacggcugguacggguuccgccaccagaacuccgagggcaccgggcaggccgccgaccucaagagcacccaggccgcgaucaaccagaucaacggcaagcugaaccggcugaucgagaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagcggacccgcaagcagcugcgcgagaacgccgaggacauggggaacggcugcuucaagaucuaccacaagugcgacaacgccugcaucgggagcauccggaacggcacguacgaccacgacgucuaccgcgacgaggcgcucaacaaccgguuccagaucaaggggguggagcugaaguccggcuacaaggacuggauccuguggaucagcuucgccaucagcugcuuccuccugugcgucgugcugcucggcuucaucaugugggccugccagaaggggaacauccgcugcaacaucugcaucuga

SEQ ID NO: 69679 - RNA, 1701 nt, Artificial Sequence
  derived and/or modified sequence opt1 from hemagglutinin__InfluenzaA__AFH00461
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaucaacgagaacuucaacuggaccgggguggcccaggacggcaaguccuacgccugcaagcgcgggagcgugaacuccuucuucagccggcucaacuggcugcacaagcuggacuacaaguaccccgcgcucaacgucaccaugcccaacaacggcaaguucgacaagcuguacaucuggggcgugcaccacccguccaccgacagcgaccagaucucccuguacgugcgcagcuccgggcgggucacggugagcaccaagcgcagccagcagaccgugauccccgacaucggcuaccggcccuggguccgcgggcucuccagccggaucuccaucuacuggaccaucgugaagcccggcgacauccugcugaucaacagcacggggaaccucaucgccccgcgcggcuacuucaagcugcggaacggcaaguccagcaucaugcgcuccgacgcccccaucgggaacugcagcuccggcugcaucacccccaacgggagcauccccaacgacaagccguuccagaacgugaaccggaucaccuacggcgccugcccccgcuacgucaagcagaacacccugaagcucgccacggggaugcggaacgugcccgagaagcagacccgcggcaucuucggcgcgaucgccggguucaucgagaacggcugggaggggaugguggacggcugguacggguuccggcaccagaacuccgagggcaccggccaggccgccgaccucaagagcacccaggccgcgaucgaccagaucaacgggaagcugaaccgccuggucgagaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagcgcacgcgcaagcagcugcgggagaacgccgaggacauggggaacggcugcuucaagaucuaccacaagugcgacaacgccugcaucgggagcauccgcaacggcaccuacgaccacgacguguaccgggacgaggcgcucaacaaccgcuuccagaucaagggcgucgagcugaaguccggguacaaggacuggauccuguggaucagcuucgccaucuccugcuuccuccugugcguggugcugcucggcuucaucaugugggccugccagaaggggaacauccggugcaacaucugcaucuga

SEQ ID NO: 69680 - RNA, 1701 nt, Artificial Sequence
  derived and/or modified sequence opt1 from hemagglutinin__InfluenzaA__AFH00472
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugagcgacuacgcgucccuccggagccuggucgccuccagcggcacgcuggaguucaacaacgaguccuucaacuggaccgggguggcccagaacggcaccagcuacgccugcaagcgccgguccgugaaguccuucuucucccgccucaacuggcugcacaagcuggaguacaaguacccggcgcucaacgucaccaugcccaacaacgacaaguucgacaagcuguacaucuggggcgugcaccaccccagcacggacuccgaccagaccagccuguacgugcaggccagcgggcgggucaccguguccaccaagcgcagccagcagacggugauccccaacaucgggucccggccguggguccgcggcgugagcucccggaucagcaucuacuggaccaucgugaagcccggcgacauccuccugaucaacuccaccgggaaccugaucgcgccccgcggcuacuucaagauccggagcgggaaguccagcaucaugcgcuccgacgcccccaucggcaacugcaacagcgagugcaucaccccgaacggcuccauccccaacgacaagcccuuccagaacgucaaccggaucacguacggggccugcccccgcuacgugaagcagaacacccucaagcuggccaccggcaugcggaacgugccggagaagcagacccgcgggaucuucggcgccaucgccggguucaucgagaacggcugggagggcauggucgacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcguggugcuccugggcuucaucaugugggccugccagaagggcaacauccggugcaacaucugcaucuga

SEQ ID NO: 69681 - RNA, 1701 nt, Artificial Sequence
  derived and/or modified sequence opt1 from hemagglutinin__InfluenzaA__AFH00483
augaagaccaucaucgcccugagcuacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacagcccccaccgcauccucgacggcaagaacugcacccugaucgacgcccugcucggggacccccacugcgacggcuuccagaacaaggagugggaccuguucguggagcggagcaaggccuacuccaacugcuaccccuacgacgugccggacuacgcgagccugcgcucccucgucgccagcuccggcacgcuggaguucaacaacgagagcuucaacuggaccgggguggcccagaacggcaccuccuacgccugcaagcgggggagcgugaaguccuucuucagccgccugaacuggcuccacaagcuggaguacaaguaccccgcgcugaacgucaccaugcccaacaacgacaaguucgacaagcucuacaucuggggcgugcaccaccccuccacggacagcgaccagaccucccuguacgugcaggccagcgggcgggucaccgugagcaccaagcgcucccagcagacggugaucccgaacaucggcagccggcccuggguccgcggcguguccagccggaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaacugcaacuccgagugcaucacccccaacgggagcauccccaacgacaagcccuuccagaacgucaaccggaucacguacggcgccugcccgcgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacuccgagggcacggggcaggccgccgaccugaaguccacccaggcggccaucaaccagaucaacggcaagcugaaccgccucaucgagaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccggaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcguggugcugcucggcuucaucaugugggccugccagaaggggaacauccggugcaacaucugcaucuga

SEQ ID NO: 69682 - RNA, 1701 nt, Artificial Sequence
  derived and/or modified sequence opt1 from hemagglutinin__InfluenzaA__AFH00494
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaucaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccaccgacagcgaccagacgucccuguacgugcgcgccagcgggcgggucaccguguccaccaagcgcagccagcagaccgugauccccgacaucggcuaccggcccuggguccgcgggcagagcucccggaucggcaucuacuggacgaucgugaagcccggggacauccuccugaucaacagcaccggcaaccugaucgccccgcgcggcuacuucaagauccggaacgggaaguccagcaucaugcgcuccgacgcccccaucggcaacugcagcuccgagugcaucacccccaacgggagcauccccaacgacaagccguuccagaacgugaaccggaucaccuacggcgccugcccccgcuacgucaagcagaacacgcucaagcuggcgaccgggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccucaagagcacgcaggcggccaucgaccagaucaacgggaagcugaaccgccuggucgagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacaaccacgacguguaccgggacgaggcccugaacaaccgcuuccagaucaagggcgucgagcugaaguccggguacaaggacuggauccucuggaucagcuucgccaucuccugcuuccugcugugcguggugcuccugggcuucaucaugugggccugccagaaggggaacauccggugcaacaucugcaucuga

SEQ ID NO: 69683 - RNA, 1701 nt, Artificial Sequence
  derived and/or modified sequence opt1 from hemagglutinin__InfluenzaA__AFH00505
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaucagccuguacgugcaggccuccgggcgcgucaccgugagcaccaagcggagccagcagacggugaucccgaacaucggcucccgccccuggguccgcggggugagcuccaucaucagcaucuacuggaccaucgugaagcccggcgacauccuccugaucaacuccaccgggaaccugaucgcgccccggggcuacuucaagauccggagcggcaaguccagcaucaugcgcuccgacgccccgaucgacaacugcaacagcgagugcaucacccccaacggguccauccccaacgacaagcccuuccagaacgucaaccggaucacguacggcgccugcccgcgcuacgugaagcagaacacccucaagcuggccaccgggaugcggaacgugcccgagaagcagacccgcggcaucuucggggccaucgccggcuucaucgagaacggcugggaggggauggucgacggcugguacggguuccggcaccagaacagcgagggcacggggcaggccgccgaccugaaguccacccaggcggccaucaaccagaucaacggcaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccggaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 69684 - RNA, 1701 nt, Artificial Sequence
  derived and/or modified sequence opt1 from hemagglutinin__InfluenzaA__AFH00516
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaccggcguggcccaggacgggaaguccuacgccugcaagcgcggcuccgugaacagcuucuucucccggcugaacuggcuccacaagcuggaguacaaguaccccgcgcugaacgucaccaugcccaacaacgacaaguucgacaagcucuacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccugcucaucaaguccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 69685 - RNA, 1701 nt, Artificial Sequence
  derived and/or modified sequence opt1 from hemagglutinin__InfluenzaA__AFH00527
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccagaccucccuguacgcccaggccagcgggcgggugaccgugagcaccaagcgcucccagcagacggucaucccgaacaucgggagccggcccugggugcgcggcguguccagccggaucuccauccacuggaccaucgucaagcccggcgacauccugcucaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 69686 - RNA, 1701 nt, Artificial Sequence
  derived and/or modified sequence opt1 from hemagglutinin__InfluenzaA__AFH00538
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagcgcagcuccaccgggcggaucugcgacagcccccaccgcauccucgacggcgagaacugcacccugaucgacgcccugcucggggacccccacugcgacggcuuccagaacaaggagugggaccuguucguggagcgguccaaggccuacagcaacugcuaccccuacgacgugccggacuacgcgucccugcgcagccucgucgccuccagcggcacgcuggaguucaacaacgaguccuucaacuggaccgggguggcccagaacggcaccagcuacgccugcaagcggcgcuccaucaagagcuucuucucccggcugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccuccgggcgcgugaccgugagcaccaagcggagccagcagacggucaucccgaacaucgggucccgccccugggugcggggcgugagcucccgcaucagcaucuacuggaccaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagagcggguacaaggacuggauccuguggaucuccuucgccaucagcugcuuccugcugugcgugguccugcucggcuucaucaugugggccugccagaagggcaacauccgcugcaacaucugcaucuga

SEQ ID NO: 69687 - RNA, 1701 nt, Artificial Sequence
  derived and/or modified sequence opt1 from hemagglutinin__InfluenzaA__AFH00549
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccccggggcgggugaccgugagcacccgccggucccagcagacggucauccccaacaucgggagccgccccugggugcggggcguguccagcaucaucuccaucuacuggaccaucgucaagcccggcgacauccuccugaucaacagcaccgggaaccugaucgccccgcgcggcuacuucaagauccgguccgggaaguccuccaucaugcgcagcgacgcccccaucuccaagugcaacagcgagugcaucacccccaacggcuccauccccaacgacaagccguuccagaacgugaaccggaucacguacggcgcgugcccccgcuacgugaagcagaacacccucaagcuggccaccgggaugcggaacguccccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcugugcgugguccuccugggguucaucaugugggccugccagaagggcaacauccggugcaacaucugcaucuga

SEQ ID NO: 69688 - RNA, 1701 nt, Artificial Sequence
  derived and/or modified sequence opt1 from hemagglutinin__InfluenzaA__AFH00560
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacaucccccaccagauccuggacggggagaacugcacccugaucgacgcccuccugggcgacccccacugcgacggguuccagaacaaggagugggaccuguucguggagcgguccacggccuacagcaacugcuaccccuacgacgucccggacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccaccccuccaccgacagcgaccagaucucccuguacgcccaggccccggggcgcgugaccgucagcaccaagcggagccagcagacggugauccccaacaucggcucccgccccugggugcgcggggucagcucccggaucagcaucuacuggaccaucgugaagcccggcgacauccuccugaucaacuccaccggcaaccugaucgccccgcggggguacuucaagauccgcagcggcaaguccagcaucaugcgguccgacgcccccaucgggaagugcaacagcgagugcaucacccccaacggcuccauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggccgaggggcgcauccaggaccuggagaaguacgucgaggacaccaagaucgaccucugguccuacaacgccgagcugcugguggcgcucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcugugcaucgugcuccugggguucaucaugugggcgugccagaagggcaacauccgcugcaacaucugcaucuga

SEQ ID NO: 69689 - RNA, 1701 nt, Artificial Sequence
  derived and/or modified sequence opt1 from hemagglutinin__InfluenzaA__AFH00571
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgacaacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggaccagaacgggaccuccagcgccugcaagcggcgcuccaacaagagcuucuucucccggcucaacuggcugcaccagcugaaguacaaguaccccgcccucaacgucacgaugcccaacaacgagaaguucgacaagcuguacaucuggggcgugcaccaccccagcaccgacuccgaccagaucagccuguacgcgcaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 69690 - RNA, 1701 nt, Artificial Sequence
  derived and/or modified sequence opt1 from hemagglutinin__InfluenzaA__AFH00582
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaccagcugcuuccugcugugcgugguccuccugggcuucaucaugugggccugccagaaggggaacauccgcugcaacaucugcaucuga

SEQ ID NO: 69691 - RNA, 1701 nt, Artificial Sequence; identical to SEQ ID NO: 62313
  derived and/or modified sequence opt1 from hemagglutinin__InfluenzaA__AFH00593

SEQ ID NO: 69692 - RNA, 1701 nt, Artificial Sequence; identical to SEQ ID NO: 62313
  derived and/or modified sequence opt1 from hemagglutinin__InfluenzaA__AFH00604

SEQ ID NO: 69693 - RNA, 1701 nt, Artificial Sequence
  derived and/or modified sequence opt1 from hemagglutinin__InfluenzaA__AFH00615
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcugaaccggcucaucggcaagaccaacgagaaguuccaccagaucgagaaggaguucuccgaggucgaggggcgcauccaggacaucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacgucuaccgggacgaggcccugaacaaccgcuuccagaucaaggggguggagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 69694 - RNA, 1701 nt, Artificial Sequence; identical to SEQ ID NO: 69285
  derived and/or modified sequence opt1 from hemagglutinin__InfluenzaA__AFH00626

SEQ ID NO: 69695 - RNA, 1701 nt, Artificial Sequence
  derived and/or modified sequence opt1 from hemagglutinin__InfluenzaA__AFH00637
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcuccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccaacaacgaccagaucucccuguacacccaggccagcggccggaucacggugagcaccaagcgcucccagcagaccgugaucccgaacaucggcagccggccccgcguccgggacauccccucccgcaucagcaucuacuggaccaucgugaagcccggggacauccugcucaucaacuccacgggcaaccugaucgcgccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgccacggggaugcgcaacgugcccgagaagcagacccggggcaucuucggggccaucgcgggcuucaucgagaacggcugggaggggaugguggacggcugguacggguuccgccaccagaacagcgagggcaucgggcaggccgccgaccugaaguccacccaggccgccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgcggagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcugaaguccggcuacaaggacuggauccuguggaucuccuucgcgaucagcugcuuccuccugugcguggcccugcucggguucaucaugugggccugccagaagggcaacauccggugcaacaucugcaucuga

SEQ ID NO: 69696 - RNA, 1701 nt, Artificial Sequence
  derived and/or modified sequence opt1 from hemagglutinin__InfluenzaA__AFH00648
augaagaccaucaucgcccugagcuacauccucugccugguguucgcccagaagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacgacgagagcuucaacuggaccggcgugacccagaacgggaccuccagcuccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcagccagcagaccgucaucccgaacaucggcucccggccccgcauccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 69697 - RNA, 1701 nt, Artificial Sequence
  derived and/or modified sequence opt1 from hemagglutinin__InfluenzaA__AFH00659
augaagaccaucaucgcccugagcuacauccucugccugguguucacccagaagcugcccggcaacgacaacuccacggccacccucugccuggggcaccacgcggucccgaacggcaccauggugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggcccacuccaacugcuaccccuacgacgugccggacuacgccagccugcggucccucaucgcgagcuccggcacccuggaguucaacaacgagagcuucaacuggaccggggucacccagaacggcacguccagcgccugcaagcgccgguccgacaacagcuucuucucccgccugaacuggcucacccaccugaaguucaaguaccccgcccugaacgugaccaugcccaacaacgaggaguucgacaagcucuacaucuggggcgugcaccaccccgggaccgacaacgaccagaucagccuguacgcccaggcguccgggcggaucacggucagcaccaagcgcagccagcagaccgugaucccgaacaucggcucccggccccgcgugcgggacauccccagccgcaucuccaucuacuggaccaucgucaagcccggcgacauccugcucaucaacagcacggggaaccugaucgccccgcggggcuacuucaagauccgcuccgggaaguccuccaucaugcggagcgacgcccccaucggcaagugcaacuccggcugcaucacccccaacgggagcauccccaacgacaagccguuccagaacgugaaccgcaucaccuacggcgccugcccccgguacgugaagcagaacacccugaagcucgccacggggaugcgcaacguccccgagaagcagacccggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 69698 - RNA, 1701 nt, Artificial Sequence
  derived and/or modified sequence opt1 from hemagglutinin__InfluenzaA__AFH00670
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccuccaccccgggaccgacaacgaccagaucuuccuguacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcucaucaacuccaccgggaaccugaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaagggcguggagcucaagagcggguacaaggacuggauccuguggaucuccuucgccaucagcugcuuccugcugugcguggcccugcucggcuucaucaugugggccugccagaaggggaacauccggugcaacaucugcaucuga

SEQ ID NO: 69699 - RNA, 1701 nt, Artificial Sequence
  derived and/or modified sequence opt1 from hemagglutinin__InfluenzaA__AFH00681
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaaggagaaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69700 - RNA, 1701 nt, Artificial Sequence; identical to SEQ ID NO: 62936
  derived and/or modified sequence opt1 from hemagglutinin__InfluenzaA__AFH00692

SEQ ID NO: 69701 - RNA, 1701 nt, Artificial Sequence
  derived and/or modified sequence opt1 from hemagglutinin__InfluenzaA__AFH00703
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggaagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguacagcgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcagaccgugauccccaacaucggcucccggccgcgcguccggaacauccccagccgcaucuccaucuacuggaccaucgugaagcccggcgacauccugcucaucaacagcaccgggaaccugaucgcgccccggggcuacuucaagaugcaguccgggaaguccuccaucaugcgcagcgacgccccgaucggcaagugcaacuccgagugcaucacgcccaacggcagcauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 69702 - RNA, 1701 nt, Artificial Sequence
  derived and/or modified sequence opt1 from hemagglutinin__InfluenzaA__AFH00714
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgacaaguccuucuucagccggcugaacuggcucuacgaguccgagagcaaguaccccgugcugaacgucaccaugcccaacaacggcaacuucgacaagcuguacaucuggggcgugcaccaccccuccacggacaaggagcagaccaaccucuacgugcgcgccagcgggcgggucaccgugagcaccaagcgcucccagcagacgaucaucccgaacaucggcagccggcccugggugcgcgggcuguccagcggcaucuccaucuacuggaccaucgucaagcccggcgacauccugcucaucaacagcaacgggaaccugaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaacaagaucaccuacggcgccugcccgaaguacgugaagcagaacacccugaagcucgccaccggcaugcgcaacguccccgagaagcagacgcgggggaucuucggcgccaucgcgggguucaucgagaacggcugggaggggaugguggacggcugguacggcuuccgccaccagaacuccgaggggaccggccaggccgccgaccucaagagcacccaggccgccaucgaccagaucaacgggaagcugaaccgggugaucgagaagaccaacgagaaguuccaccagaucgagaaggaguucuccgaggucgagggccgcauccaggaccucgagaaguacguggaggacacgaagaucgaccuguggagcuacaacgcggagcugcucguggcccuggagaaccagcacaccaucgaccugaccgacuccgagaugaacaagcuguucgagaagacccggcgccagcugcgggagaacgccgaggacauggggaacggcugcuucaagaucuaccacaagugcgacaacgccugcaucggcagcauccgcaacgggacguacgaccacgacgucuaccgcgacgaggcccugaacaaccgguuccagaucaagggcguggagcucaaguccggguacaaggacuggauccuguggaucagcuucgcgaucagcugcuuccugcucugcgucgugcugcugggcuucaucaugugggccugccagaagggcaacauccgcugcaacaucugcaucuga

SEQ ID NO: 69703 - RNA, 1701 nt, Artificial Sequence
  derived and/or modified sequence opt1 from hemagglutinin__InfluenzaA__AFH00725
augaagaccaucaucgcccugagcuacaucuucugccucaucuucgcccagaaccugcccggcaacgacaacuccaccgcgacgcugugccucgggcaccacgccgugccgaacggcacccuggucaagaccaucaccaacgaccagaucgaggugacgaacgccaccgagcuggugcagagcuccagcaccgggcgcaucugcgacagcccccaccggauccucgacggcaagaacugcacccugaucgacgcccugcucggggacccccacugcgacggcuuccagaacgagaagugggaccuguucgucgagcgcuccaaggccuucuccaacugcuaccccuacgacgugccggacuacgcgagccugcggucccucguggccagcuccggcacgcuggaguucaucaacgagggguucaacuggaccggcgucacccagagcgggggcuccuacgccugcaagcgcgggagcgacaacuccuucuucagccggcugaacuggcucuacgaguccgagagcaaguaccccgugcugaacgugaccaugcccaacaacggcaaguucgacaagcuguacaucuggggcguccaccaccccuccacggacaaggagcagaccaagcucuacgugcgcgccagcgggcgggugaccgucagcaccaagcgcucccagcagacggugaucccgaacaucggcagccggcccugggugcgcgggcuguccagccggaucuccaucuacuggaccaucgucaagcccggcgacauccugcucaucaacagcaccggcaaccugaucgcgccccgcggguacuucaagauccggaccggcaaguccagcaucaugcgcuccgacgccccgaucgggacgugcagcuccgagugcaucacccccaacggcagcauccccaacgacaagcccuuccagaacgugaacaagaucaccuacggggccugcccgcgguacgugaagcagaacacccugaagcucgccacgggcaugcgcaacguccccgagaagcagacccggggcaucuucggggccaucgcgggcuucaucgagaacgggugggagggcaugguggacgggugguacggcuuccgccaccagaacuccgagggcaccgggcaggccgccgaccucaagagcacccaggccgccaucgaccagaucaacggcaagcugaaccgggugaucgagaagacgaacgagaaguuccaccagaucgagaaggaguucuccgaggucgaggggcgcauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcggaagcagcugcgcgagaacgccgaggacaugggcaacgggugcuucaagaucuaccacaagugcgacaacgccugcaucggcagcauccgcaacggcaccuacgaccacgacgucuaccgggacgaggcccugaacaaccgcuuccagaucaaggggguggagcucaaguccggcuacaaggacuggauccuguggaucagcuucgcgaucagcugcuuccugcucugcgucgugcugcugggguucaucaugugggccugccagaagggcaacauccggugcaacaucugcaucuga

SEQ ID NO: 69704 - RNA, 1701 nt, Artificial Sequence; identical to SEQ ID NO: 68074
  derived and/or modified sequence opt1 from hemagglutinin__InfluenzaA__AFH00736

SEQ ID NO: 69705 - RNA, 1701 nt, Artificial Sequence
  derived and/or modified sequence opt1 from hemagglutinin__InfluenzaA__AFH00747
augaagaccaucaucgcccugagcuacaucuucugccucguguucgcccagaagcugcccggcaacgacaacuccaccgcgacgcugugccucgggcacuacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaaguccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugagcaccaagcggagccagcagacggugaucccgaacaucgggucccgccccuggguccggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 69706 - RNA, 1701 nt, Artificial Sequence
  derived and/or modified sequence opt1 from hemagglutinin__InfluenzaA__AFH00758
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgaguccuacgccugcaagcgcgggagcgugaaguccuucuucagccggcucaacuggcugcacgaguccgaguacaaguaccccgcgcugaacgucaccaugcccaacaacggcaaguucgacaagcucuacaucuggggcgugcaccaccccagcaccgaccgcgagcagacgaagcuguacgugcgggccuccgggcgcgucaccgugagcaccaagcggagccagcagaccgugaucccgaacaucggcucccgccccuggguccgggggcugagcucccgcaucagcaucuacuggacgaucgugaagcccggcgacauccuccugaucaacuccaccgggaaccugaucgcgccccggggcuacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 69707 - RNA, 1701 nt, Artificial Sequence
  derived and/or modified sequence opt1 from hemagglutinin__InfluenzaA__AFH00769
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgaguccuacacgugcaagcgcgggagcgugaaguccuucuucagccggcucaacuggcugcacgaguccgaguacaaguaccccgcccugaacgucaccaugcccaacaacgacaaguucgacaagcucuacaucuggggcgugcaccaccccagcaccgaccgcgagcagaccucccuguacauccgggcgagcgggcgcgugaccgucagcaccaagcggucccagcagacggugaucccgaacaucggcagccgccccugggugcggggccuguccagccgcaucuccaucuacuggaccaucgucaagcccggggacauccuccugaucaacagcaccggcaaccugaucgcgccccggggguacuucaagauccgcaccggcaaguccagcaucaugcgguccgacgccccgaucggcacgugcagcuccgagugcaucacccccaacgggagcauccccaacgacaagcccuuccagaacgugaaccgcaucaccuacggcgccugcccgcgguacgugaagcagaacacccucaagcuggccacggggaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacccaggccgcgaucgaccagaucaacggcaagcucaaccggcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 69708 - RNA, 1701 nt, Artificial Sequence
  derived and/or modified sequence opt1 from hemagglutinin__InfluenzaA__AFH00780
augcgcgccaucaucgcccugagcuacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagagcuccagcaccgggcggaucugcgacagcccccaccgcauccuggacggcaagaacugcacccugaucgacgcccuccugggggacccccacugcgacggcuuccagaacaaggagugggaccuguucguggagcggagcaaggcguacuccgacugcuaccccuacgacgugccggacuacgccagccuccgcucccuggucgccagcuccggcacccuggaguucacgaacgagggguucaacuggaccggcguggcccaggacgggaccagcuacgcgugcaagcggggcuccgugaaguccuucuucucccgccucaacuggcugcacaagcuggaguacaaguaccccgcccucaacgucaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucggcucccggcccuggguccgcggggugagcucccggaucagcaucuacuggaccaucgugaagcccggcgacauccuccugaucaacuccaccgggaaccugaucgcgccccgcggcuacuucaagauccggagcggcaaguccagcaucaugcgcuccgacgccccgaucgggaacugcaacagcgagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggcuucaucgagaacgggugggagggcauggucgacgggugguacggcuuccggcaccagaacagcgaggggacgggccaggccgcggaccugaaguccacccaggccgccaucaaccagaucaacggcaagcucaaccgccugaucgagaagaccaacgagaaguuccaccagaucgagaaggaguucagcgagguggaggggcggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcugugcguggugcuccugggguucaucaugugggccugccagaagggcaacauccggugcaacaucugcaucuga

SEQ ID NO: 69709 - RNA, 1701 nt, Artificial Sequence
  derived and/or modified sequence opt1 from hemagglutinin__InfluenzaA__AFH00791
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacagcccccaccagauccuggacgggaagaacugcacccugaucgacgcccuccugggcgacccccacugcgacggcuuccagaacaaggagugggaccuguucguggagcgguccacggccuacagcaacugcuaccccuacgacgugccggacuacgcgucccuccgcagccuggucgccuccagcgggacccuggaguucaccaaggagggcuucaacuggaccgggguggcccaggacggcacguccuacacgugcaagcgggggagcgugaaguccuucuucagccgccucaacuggcugcacaagcuggaguacaaguaccccgcccucaacgucaccaugcccaacaacgacaaguucgacaagcuguacaucuggggcgugcaccaccccuccaccgacagcgaccagaccucccuguacgugcaggcgagcggccgggucaccguguccaccaagcgcagccagcagaccgugaucccgaacaucgggagccggcccuggguccgcggcguguccagccggaucuccaucuacuggacgaucgugaagcccggggacauccuccugaucaacagcaccggcaaccugaucgcgccccgcggcuacuucaagauccgguccggcaagagcuccaucaugcgcagcgacgccccgaucgacaacugcaacuccgagugcaucacccccaacgggagcauccccaacgacaagcccuuccagaacgucaaccggaucaccuacggggccugcccgcgcuacgugaagcagaacacgcucaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagagcacgcaggccgcgaucaaccagaucaacggcaagcugaaccgccugaucgagaagaccaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugacggacuccgagaugaacaagcuguucgagcgcacccggaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggcuacaaggacuggauccucuggaucagcuucgccaucuccugcuuccugcugugcguggugcuccugggguucaucaugugggccugccagaagggcaacauccggugcaacaucugcaucuga

SEQ ID NO: 69710 - RNA, 1701 nt, Artificial Sequence; identical to SEQ ID NO: 62350
  derived and/or modified sequence opt1 from hemagglutinin__InfluenzaA__AFH00802

SEQ ID NO: 69711 - RNA, 1701 nt, Artificial Sequence
  derived and/or modified sequence opt1 from hemagglutinin__InfluenzaA__AFH00813
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccgggacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 69712 - RNA, 1701 nt, Artificial Sequence
  derived and/or modified sequence opt1 from hemagglutinin__InfluenzaA__AFH00824
augaagaccaucaucgcccugagcuacauccuccgccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcaacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcgacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 69713 - RNA, 1701 nt, Artificial Sequence
  derived and/or modified sequence opt1 from hemagglutinin__InfluenzaA__AFH01407
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 69714 - RNA, 1701 nt, Artificial Sequence
  derived and/or modified sequence opt1 from hemagglutinin__InfluenzaA__AFH34940
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacgggguccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacaaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 69715 - RNA, 1701 nt, Artificial Sequence
  derived and/or modified sequence opt1 from hemagglutinin__InfluenzaA__AFH34961
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccgccagcggcacgcuggaguucaacaacgaguccuucaacuggaccggggugacccagaacggcaccagcuccgccugcauccgccggagcaacuccagcuucuucucccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccagagcuccgggcggaucaccgugagcacgaagcgcagccagcaggccgugaucccgaacaucggcucccggccccgcauccggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 69716 - RNA, 1701 nt, Artificial Sequence
  derived and/or modified sequence opt1 from hemagglutinin__InfluenzaA__AFH34968
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccgccagcggcacgcuggaguucaacaacgaguccuucaacuggaccggggugacccagaacggcaccagcuccgccugcauccgccggagcaacuccagcuucuucucccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccagagcuccgggcggaucaccgugagcacgaagcgcagccagcaggccgugaucccgaacaucggcucccggccccgcauccgggacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacccccaacggcagcauccccaacgacaagccguuccagaacgugaaccgcaucacguacggggccugcccccgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 69717 - RNA, 1701 nt, Artificial Sequence
  derived and/or modified sequence opt1 from hemagglutinin__InfluenzaA__AFH34975
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggaacggggugacgcagaacggcaccagcuccgccugcauccggcgcagcaacaacuccuucuucagccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagccguccgggcgcaucaccgugagcaccaagcggucccagcaggccgugauccccaacaucggcagccgcccccggauccgcaacauccccagccggaucuccaucuacuggaccaucgucaagccgggcgacauccugcucaucaacagcacggggaaccugaucgcgccccgcggcuacuucaagauccgguccggcaagagcuccaucaugcgcagcgacgcccccaucgggaagugcaaguccgagugcaucacccccaacggcagcaucccgaacgacaagcccuuccagaacgugaaccggaucaccuacggggccugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 69718 - RNA, 1701 nt, Artificial Sequence; identical to SEQ ID NO: 64419
  derived and/or modified sequence opt1 from hemagglutinin__InfluenzaA__AFH74464

SEQ ID NO: 69719 - RNA, 1701 nt, Artificial Sequence; identical to SEQ ID NO: 63677
  derived and/or modified sequence opt1 from hemagglutinin__InfluenzaA__AFH74465

SEQ ID NO: 69720 - RNA, 1701 nt, Artificial Sequence; identical to SEQ ID NO: 64438
  derived and/or modified sequence opt1 from hemagglutinin__InfluenzaA__AFH74477

SEQ ID NO: 69721 - RNA, 1701 nt, Artificial Sequence
  derived and/or modified sequence opt1 from hemagglutinin__InfluenzaA__AFH74488
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacaacccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 69722 - RNA, 1701 nt, Artificial Sequence; identical to SEQ ID NO: 64419
  derived and/or modified sequence opt1 from hemagglutinin__InfluenzaA__AFH74499

SEQ ID NO: 69723 - RNA, 1701 nt, Artificial Sequence; identical to SEQ ID NO: 64621
  derived and/or modified sequence opt1 from hemagglutinin__InfluenzaA__AFH74510

SEQ ID NO: 69724 - RNA, 1701 nt, Artificial Sequence
  derived and/or modified sequence opt1 from hemagglutinin__InfluenzaA__AFH74521
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguccaaguaccccgcccucaacgugaccaugcccaacaacgagcaguucgacaagcuguacaucuggggcguccaccaccccgggaccgacaacgaccagaucuuccuguacgcgcaggccagcgggcggaucaccgugagcacgaagcgcucccagcagaccgugaucccgaacaucggcagccggccccgcauccgggacauccccucccgcaucagcaucuacuggaccaucgucaagcccggcgacauccuccugaucaacuccaccgggaaccugaucgccccgcggggcuacuucaagauccgcagcgggaaguccagcaucaugaaguccgacgcccccaucggcaagugcaacagcgagugcaucacgcccaacggcuccauccccaacgacaagccguuccagaacgugaaccggaucaccuacggggccugcccccgcuacgugaagcagaacacccucaagcuggcgaccggcaugcggaacguccccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagaccaacgagaaguuccaccagaucgagaaggaguucagcgagguggagggccgcauccaggaccuggagaaguacgucgaggacaccaagguggaccucugguccuacaacgccgagcugcugguggcccucgagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 69725 - RNA, 1701 nt, Artificial Sequence; identical to SEQ ID NO: 67996
  derived and/or modified sequence opt1 from hemagglutinin__InfluenzaA__AFH74532

SEQ ID NO: 69726 - RNA, 1701 nt, Artificial Sequence; identical to SEQ ID NO: 64621
  derived and/or modified sequence opt1 from hemagglutinin__InfluenzaA__AFH74543

SEQ ID NO: 69727 - RNA, 1701 nt, Artificial Sequence; identical to SEQ ID NO: 64621
  derived and/or modified sequence opt1 from hemagglutinin__InfluenzaA__AFH74554

SEQ ID NO: 69728 - RNA, 1701 nt, Artificial Sequence; identical to SEQ ID NO: 64621
  derived and/or modified sequence opt1 from hemagglutinin__InfluenzaA__AFH74565

SEQ ID NO: 69729 - RNA, 1701 nt, Artificial Sequence; identical to SEQ ID NO: 64621
  derived and/or modified sequence opt1 from hemagglutinin__InfluenzaA__AFH74576

SEQ ID NO: 69730 - RNA, 1701 nt, Artificial Sequence; identical to SEQ ID NO: 64621
  derived and/or modified sequence opt1 from hemagglutinin__InfluenzaA__AFH74587

SEQ ID NO: 69731 - RNA, 1701 nt, Artificial Sequence
  derived and/or modified sequence opt1 from hemagglutinin__InfluenzaA__AFH74598
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacgggaagaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcagaccgccaucccgaacaucgggagccggccccgcgugcggaacauccccucccgcaucagcaucuacuggaccaucgucaagcccggcgacauccugcucaucaacuccaccggcaaccugaucgccccgcggggguacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacgggugggagggcaugguggacggcugguacggguuccgccaccagaacagcgagggccgggggcaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 69732 - RNA, 1701 nt, Artificial Sequence; identical to SEQ ID NO: 64419
  derived and/or modified sequence opt1 from hemagglutinin__InfluenzaA__AFH74609

SEQ ID NO: 69733 - RNA, 1701 nt, Artificial Sequence; identical to SEQ ID NO: 64621
  derived and/or modified sequence opt1 from hemagglutinin__InfluenzaA__AFH74620

SEQ ID NO: 69734 - RNA, 1701 nt, Artificial Sequence
  derived and/or modified sequence opt1 from hemagglutinin__InfluenzaA__AFH74631
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaccaacugcacgcugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucacgguguccaccaagcgcagccagcagaccgccaucccgaacaucggcagccggccccgcgugcggaacauccccucccgcaucagcaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggcgugcccccgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 69735 - RNA, 1701 nt, Artificial Sequence; identical to SEQ ID NO: 64419
  derived and/or modified sequence opt1 from hemagglutinin__InfluenzaA__AFH74642

SEQ ID NO: 69736 - RNA, 1701 nt, Artificial Sequence; identical to SEQ ID NO: 64419
  derived and/or modified sequence opt1 from hemagglutinin__InfluenzaA__AFH74653

SEQ ID NO: 69737 - RNA, 1701 nt, Artificial Sequence; identical to SEQ ID NO: 64419
  derived and/or modified sequence opt1 from hemagglutinin__InfluenzaA__AFH74664

SEQ ID NO: 69738 - RNA, 1701 nt, Artificial Sequence; identical to SEQ ID NO: 64419
  derived and/or modified sequence opt1 from hemagglutinin__InfluenzaA__AFH74675

SEQ ID NO: 69739 - RNA, 1701 nt, Artificial Sequence; identical to SEQ ID NO: 69167
  derived and/or modified sequence opt1 from hemagglutinin__InfluenzaA__AFH74686

SEQ ID NO: 69740 - RNA, 1701 nt, Artificial Sequence; identical to SEQ ID NO: 69167
  derived and/or modified sequence opt1 from hemagglutinin__InfluenzaA__AFH74697

SEQ ID NO: 69741 - RNA, 1701 nt, Artificial Sequence; identical to SEQ ID NO: 64621
  derived and/or modified sequence opt1 from hemagglutinin__InfluenzaA__AFH74708

SEQ ID NO: 69742 - RNA, 1701 nt, Artificial Sequence; identical to SEQ ID NO: 64621
  derived and/or modified sequence opt1 from hemagglutinin__InfluenzaA__AFH74719

SEQ ID NO: 69743 - RNA, 1701 nt, Artificial Sequence; identical to SEQ ID NO: 64621
  derived and/or modified sequence opt1 from hemagglutinin__InfluenzaA__AFH74730

SEQ ID NO: 69744 - RNA, 1701 nt, Artificial Sequence
  derived and/or modified sequence opt1 from hemagglutinin__InfluenzaA__AFH74741
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcagaccgccaucccgaacaucggcagccggccccgcgugcggaacauccccagccgcaucuccaucuacuggaccaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 69745 - RNA, 1701 nt, Artificial Sequence; identical to SEQ ID NO: 64621
  derived and/or modified sequence opt1 from hemagglutinin__InfluenzaA__AFH74752

SEQ ID NO: 69746 - RNA, 1701 nt, Artificial Sequence; identical to SEQ ID NO: 64621
  derived and/or modified sequence opt1 from hemagglutinin__InfluenzaA__AFH74763

SEQ ID NO: 69747 - RNA, 1701 nt, Artificial Sequence; identical to SEQ ID NO: 64621
  derived and/or modified sequence opt1 from hemagglutinin__InfluenzaA__AFH74774

SEQ ID NO: 69748 - RNA, 1701 nt, Artificial Sequence; identical to SEQ ID NO: 67996
  derived and/or modified sequence opt1 from hemagglutinin__InfluenzaA__AFH74785

SEQ ID NO: 69749 - RNA, 1701 nt, Artificial Sequence; identical to SEQ ID NO: 64621
  derived and/or modified sequence opt1 from hemagglutinin__InfluenzaA__AFH74796

SEQ ID NO: 69750 - RNA, 1701 nt, Artificial Sequence; identical to SEQ ID NO: 69177
  derived and/or modified sequence opt1 from hemagglutinin__InfluenzaA__AFH74807

SEQ ID NO: 69751 - RNA, 1701 nt, Artificial Sequence; identical to SEQ ID NO: 69177
  derived and/or modified sequence opt1 from hemagglutinin__InfluenzaA__AFH74818

SEQ ID NO: 69752 - RNA, 1701 nt, Artificial Sequence; identical to SEQ ID NO: 69177
  derived and/or modified sequence opt1 from hemagglutinin__InfluenzaA__AFH74829

SEQ ID NO: 69753 - RNA, 1701 nt, Artificial Sequence; identical to SEQ ID NO: 69177
  derived and/or modified sequence opt1 from hemagglutinin__InfluenzaA__AFH74840

SEQ ID NO: 69754 - RNA, 1701 nt, Artificial Sequence
  derived and/or modified sequence opt1 from hemagglutinin__InfluenzaA__AFH74851
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacggcaacugcuaccccuacgacgugccggacuacgcgucccugcggagccucgucgccuccagcgggacgcuggaguucaacaacgaguccuucaacuggaccggcgugacccagaacgggaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcagaccgccaucccgaacaucggcagccggccccgcgugcggaacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgcgugcccccgguacgugaagcagaacacccugcgccucgccaccgggaugcggaacguccccgagaagcagacgcgcggcaucuucggggccaucgccggcuucaucgagaacggcugggaggggaugguggacggcugguacggguuccggcaccagaacuccgagggccgcgggcaggccgcggaccugaaguccacccaggccgccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccggaacgggaccuacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggcgugccagaagggcaacauccgcugcaacaucugcaucuga

SEQ ID NO: 69755 - RNA, 1701 nt, Artificial Sequence; identical to SEQ ID NO: 69180
  derived and/or modified sequence opt1 from hemagglutinin__InfluenzaA__AFH74862

SEQ ID NO: 69756 - RNA, 1701 nt, Artificial Sequence; identical to SEQ ID NO: 69180
  derived and/or modified sequence opt1 from hemagglutinin__InfluenzaA__AFH74873

SEQ ID NO: 69757 - RNA, 1701 nt, Artificial Sequence; identical to SEQ ID NO: 64621
  derived and/or modified sequence opt1 from hemagglutinin__InfluenzaA__AFH74884

SEQ ID NO: 69758 - RNA, 1701 nt, Artificial Sequence; identical to SEQ ID NO: 64621
  derived and/or modified sequence opt1 from hemagglutinin__InfluenzaA__AFH74895

SEQ ID NO: 69759 - RNA, 1701 nt, Artificial Sequence; identical to SEQ ID NO: 64621
  derived and/or modified sequence opt1 from hemagglutinin__InfluenzaA__AFH74906

SEQ ID NO: 69760 - RNA, 1701 nt, Artificial Sequence; identical to SEQ ID NO: 64419
  derived and/or modified sequence opt1 from hemagglutinin__InfluenzaA__AFH74917

SEQ ID NO: 69761 - RNA, 1701 nt, Artificial Sequence; identical to SEQ ID NO: 64621
  derived and/or modified sequence opt1 from hemagglutinin__InfluenzaA__AFH74928

SEQ ID NO: 69762 - RNA, 1701 nt, Artificial Sequence; identical to SEQ ID NO: 64621
  derived and/or modified sequence opt1 from hemagglutinin__InfluenzaA__AFH74939

SEQ ID NO: 69763 - RNA, 1701 nt, Artificial Sequence
  derived and/or modified sequence opt1 from hemagglutinin__InfluenzaA__AFH74950
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacggcaacugcuaccccuacgacgugccggacuacgcgucccugcggagccucgucgccuccagcgggacgcuggaguucaacaacgaguccuucaacuggaccggcgugacccagaacgggaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcagaccgccaucccgaacaucggcagccggccccgcgugcggaacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgcgugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggccgggggcaggccgcggaccugaaguccacccaggccgccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 69764 - RNA, 1701 nt, Artificial Sequence; identical to SEQ ID NO: 69180
  derived and/or modified sequence opt1 from hemagglutinin__InfluenzaA__AFH74961

SEQ ID NO: 69765 - RNA, 1701 nt, Artificial Sequence; identical to SEQ ID NO: 64621
  derived and/or modified sequence opt1 from hemagglutinin__InfluenzaA__AFH75388

SEQ ID NO: 69766 - RNA, 1701 nt, Artificial Sequence
  derived and/or modified sequence opt1 from hemagglutinin__InfluenzaA__AFH97140
augaaggccauccuggugguccuccuguacaucuucgccaccgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 69767 - RNA, 1701 nt, Artificial Sequence
  derived and/or modified sequence opt1 from hemagglutinin__InfluenzaA__AFJ05142
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagugcuucaacuggaccggggugacccagaacggcaccagcuccgccugcauccgccggagcaacuccagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcagagcuccgggcggaucaccgugagcacgaagcgcagccagcaggccgugaucccgaacaucggcucccggccccgcauccggaacauccccagccgcaucuccaucuacuggaccaucgucaagcccggcgacauccugcugaucaacagcaccgggaaccucaucgccccgcggggcuacuucaagauccgcuccgggaaguccuccaucaugcggagcgacgcccccaucggcaagugcaacuccggcugcaucacccccaacgggagcauccccaacgacaagccguuccagaacgugaaccgcaucacguacggcgccugcccccgguacgugaagcaguccacccugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacgcaggcggccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccgcaacgggaccuacaaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 69768 - RNA, 1701 nt, Artificial Sequence
  derived and/or modified sequence opt1 from hemagglutinin__InfluenzaA__AFJ05144
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagagcacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 69769 - RNA, 1701 nt, Artificial Sequence
  derived and/or modified sequence opt1 from hemagglutinin__InfluenzaA__AFJ11706
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcuccagcaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcgcaucaccgugagcacgaagcggagccagcaggccgugaucccgaacaucggcucccgcccccggguccgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacccccaacggcagcauccccaacgacaagccguuccagaacgugaaccggaucacguacggggcgugcccccgcuacgucaagcaguccacccugaagcucgccaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaccaucuaccacaagugcgacaacgccugcaucggguccauccgcaacggcaccuacgaccacaacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 69770 - RNA, 1701 nt, Artificial Sequence; identical to SEQ ID NO: 67990
  derived and/or modified sequence opt1 from hemagglutinin__InfluenzaA__AFJ11728

SEQ ID NO: 69771 - RNA, 1701 nt, Artificial Sequence
  derived and/or modified sequence opt1 from hemagglutinin__InfluenzaA__AFJ19842
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucaacaaccgguuccagaucaaggggaucgagcugaaguccggcuacaaggacuggauccuguggaucagcuucgccaucuccugcuuccuccugugcgucgcgcugcucggcuucaucaugugggccugccagaaggggaacauccgcugcaacaucugcaucuga

SEQ ID NO: 69772 - RNA, 1701 nt, Artificial Sequence; identical to SEQ ID NO: 69369
  derived and/or modified sequence opt1 from hemagglutinin__InfluenzaA__AFJ20171

SEQ ID NO: 69773 - RNA, 1701 nt, Artificial Sequence; identical to SEQ ID NO: 67990
  derived and/or modified sequence opt1 from hemagglutinin__InfluenzaA__AFJ20182

SEQ ID NO: 69774 - RNA, 1701 nt, Artificial Sequence
  derived and/or modified sequence opt1 from hemagglutinin__InfluenzaA__AFJ74386
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcgugauguccagccacuacucccgccgguucaccccggagaucgccaagcgccccaagguccgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgugaccaucggcgagugccccaaguacguccgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucgacggcaucacgaacaaggugaacagcgucaucgagaagaugaacacccaguucaccgccguggggaaggaguucaacaagcuggagcgccggauggagaaccucaacaagaagguggacgacggcuuccuggacaucuggaccuacaacgcggagcugcucguccugcuggagaacgagcgcacgcucgacuuccacgacagcaacgugaagaaccuguacgagaaggucaagaaccagcugaagaacaacgccaaggagaucgggaacggcugcuucgaguucuaccacaagugcaacaacgagugcauggaguccgugaagaacgggaccuacgacuaccccaaguacagcggcgaguccaagcucaaccgggagaagaucgacggcgugaagcuggagagcaugggggucuaccagauccuggccaucuacagcaccguggccuccagccucgugcugcuggucucccucggcgccaucagcuucuggaugugcuccaacgggagccugcagugccgcaucugcaucuga

SEQ ID NO: 69775 - RNA, 1701 nt, Artificial Sequence
  derived and/or modified sequence opt1 from hemagglutinin__InfluenzaA__AFJ74407
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcagcuccgagugcaucacgcccaacggcagcauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccucaagagcacccaggcggccaucaaccagaucaacggcaagcugaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 69776 - RNA, 1701 nt, Artificial Sequence
  derived and/or modified sequence opt1 from hemagglutinin__InfluenzaA__AFJ74418
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaucaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 69777 - RNA, 1701 nt, Artificial Sequence
  derived and/or modified sequence opt1 from hemagglutinin__InfluenzaA__AFJ74437
augaagaccaucaucgcccugagcuacauccucugcaagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgcgagccugcgcucccucgucgccagcuccggcacgcuggaguucaacaacgagagcuucaacuggaccgggguggcccagaacggcaccuccagcgccugcaagcggcgcuccaucaagagcuucuucucccggcugaacuggcuccaccagcugaaguacaaguaccccgcgcugaacgugaccaugcccaacaacgagaaguucgacaagcucuacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcugaagcucgccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcaacaucugcaucuga

SEQ ID NO: 69778 - RNA, 1701 nt, Artificial Sequence
  derived and/or modified sequence opt1 from hemagglutinin__InfluenzaA__AFJ74448
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccucgggggcccccacugcgacggcuuccagaacaaggagugggaccuguucguggagcggagcaaggccuacuccaacugcuaccccuacgacgugccggacuacgcgagccugcgcucccuggucgccagcuccgggacgcuggaguucaacaacgagagcuucaacuggaccggcguggcccagaacgggaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucggcucccgccccugggugcggggcgugagcucccgcaucagcaucuacuggacgaucgucaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugguggacggcugguacggguuccgccaccagaacagcgagggcaccgggcaggccgcggaccugaaguccacgcaggccgccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 69779 - RNA, 1701 nt, Artificial Sequence
  derived and/or modified sequence opt1 from hemagglutinin__InfluenzaA__AFJ74459
auggaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgugagcuccuucgagcgcuucgagaucuucccgaaggagagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaacaaggagaaggagguccuggugcuguggggcgugcaccaccccagcaacaucggggaccagcgggccaucuaccacaccgagaacgcguacgucagcgugguguccagccacuacucccgccgguucaccccggagaucgccaagcgccccaagguccggaaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgugaccaucggcgagugccccaaguacguccgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucacgaacaaggugaacagcaucaucgagaagaugaacacccaguucaccgccgucgggaaggaguucaacaagcuggagcgccggauggagaaccucaacaagaagguggacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgucaagaacgggaccuacgacuaccccaaguacagcaaggaguccaagcucaaccgggagaagaucgacggcgugaagcuggagagcaugggcguguaccagauccuggccaucuacagcaccgucgccuccagccucgugcugcuggugucccucggggccaucagcuucuggaugugcuccaacggcagccugcagugccgcaucugcaucuga

SEQ ID NO: 69780 - RNA, 1701 nt, Artificial Sequence
  derived and/or modified sequence opt1 from hemagglutinin__InfluenzaA__AFJ74470
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcgugaaguccuucuucagccgccucaacuggcugcacaagcuggaguacaaguaccccgcgcucaacgucaccaugcccaacaacgacaaguucgacaagcuguacaucuggggcgugcaccaccccuccacggacagcgaccagaucucccuguacgcccagaccagcgggcgggugaccgucagcaccaagcgcucccagcagacggugaucccgaacaucgggagccggcccugggugcgcggcgucuccagccggaucuccaucuacuggaccaucgugaagcccggcgacauccuccugaucaacagcaccgggaaccugaucgcgccccgcggcuacuucaagauccgguccgggaaguccuccaucaugcgcagcgacgccccgaucggcaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacaaccacgacgucuaccgggacgaggcccugaacaaccgcuuccagaucaagggcguggagcucaagagcggguacaaggacuggauccuguggaucagcuucgccaucuccugcuuccugcugugcgucgugcuccugggcuucaucaugugggccugccagaagggcaacauccggugcaacaucugcaucuga

SEQ ID NO: 69781 - RNA, 1701 nt, Artificial Sequence
  derived and/or modified sequence opt1 from hemagglutinin__InfluenzaA__AFJ74492
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacaagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcuccaucaucagcaucuacuggacgaucgucaagcccggcgacauccuccugaucaacuccaccgggaaccugaucgcgccccgcggcuacuucaagauccggaacgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucggcaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguucaagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 69782 - RNA, 1701 nt, Artificial Sequence
  derived and/or modified sequence opt1 from hemagglutinin__InfluenzaA__AFJ74525
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccaggacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcuccaucaucagcaucuacuggaccaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacgggaccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucaaccagaucaacgggaagcucaaccggcugaucgagaagaccaacgagaaguuccaccagaucgagaaggaguucagcgagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 69783 - RNA, 1701 nt, Artificial Sequence; identical to SEQ ID NO: 69781
  derived and/or modified sequence opt1 from hemagglutinin__InfluenzaA__AFJ74535

SEQ ID NO: 69784 - RNA, 1701 nt, Artificial Sequence
  derived and/or modified sequence opt1 from hemagglutinin__InfluenzaA__AFJ74560
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcagaccagcgggcgcgugaccgucagcaccaagcggucccagcagacggugaucccgaacaucggcagcggccccugggugcgcggggucuccagccggaucuccaucuacuggaccaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucacguacgggccgugcccccgcuacgucaagcagaacacccucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggacgggccaggccgccgaccugaaguccacccaggccgccaucaaccagaucaacggcaagcucaaccgccugguggagaagaccaacgagaaguuccaccagaucgagaaggaguucuccgaggucgaggggcggauccaggaccuggagaaguacguggaggacaccaagaucgaccucuggagcuacaacgcggagcugcugguggcccucgagaaccagcacacgaucgaccugaccgacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacgucuaccgcgacgaggcccugaacaaccgguuccagaucaagggcguggagcugaaguccggcuacaaggacuggauccucuggaucagcuucgcgaucagcugcuuccugcugugcaucguccuccugggguucaucaugugggccugccagaagggcaacauccgcugcaacaucugcaucuga

SEQ ID NO: 69785 - RNA, 1701 nt, Artificial Sequence
  derived and/or modified sequence opt1 from hemagglutinin__InfluenzaA__AFJ74634
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcagcugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 69786 - RNA, 1698 nt, Artificial Sequence
  derived and/or modified sequence opt1 from hemagglutinin__InfluenzaA__AFJ74653
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgcgcccuguaccacaccgacaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 69787 - RNA, 1698 nt, Artificial Sequence
  derived and/or modified sequence opt1 from hemagglutinin__InfluenzaA__AFJ74673
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugcgcaagagcuacgccaacaacaaggagaaggaggugcucguccuguggggcgugcaccacccgcccaacaucggcgaccagcgggcccuguaccacaccgacaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggccagcagccuggugcuccuggucucccugggggccaucagcuucuggaugugcuccaacggcagccuccagugccgcaucugcaucuga

SEQ ID NO: 69788 - RNA, 1701 nt, Artificial Sequence
  derived and/or modified sequence opt1 from hemagglutinin__InfluenzaA__AFJ74674
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaagaagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccgggacggacagcgaccagaucucccuguacgcccaggccagcggccggaucaccgugagcaccaagcgcucccagcagaccgugaucccgaacaucggcagccggccccgcguccgggacguguccagccgcaucuccaucuacuggacgaucgugaagcccggggacauccuccugaucaacagcaccggcaaccugaucgcgccccggggguacuucaagauccgcuccggccggagcuccaucaugcgcagcgacgccccgaucggcaagugcaacuccgagugcaucacccccaacgggagcauccccaacgacaagcccuuccagaacgucaaccggaucaccuacggcgccugcccgcgcuacgugaagcagaacacgcucaagcuggccaccgggaugcggaacgugcccgagaagcagccccgcggcaucuucggggccaucgccggcuucaucgagaacggcugggaggggauggucgacggcugguacggguuccggcaccagaacuccgagggcaccgggcaggccgcggaccugaaguccacccaggccgccaucaaccagaucaacggcaagcucaaccgccugaucggcaagacgaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcguggagcugaaguccggcuacaaggacuggauccucuggaucagcuucgccaucagcugcuuccugcugugcgucgcccuccugggguucaucaugugggcgugccagaagggcaacauccgcugcaacaucugcaucuga

SEQ ID NO: 69789 - RNA, 1698 nt, Artificial Sequence; identical to SEQ ID NO: 69786
  derived and/or modified sequence opt1 from hemagglutinin__InfluenzaA__AFJ74694

SEQ ID NO: 69790 - RNA, 1701 nt, Artificial Sequence
  derived and/or modified sequence opt1 from hemagglutinin__InfluenzaA__AFJ74695
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccagauccuggacggcgagaacugcacccugaucgacgcccuccugggggacccccacugcgacggcuuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccgggguggcccaggacggcaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcgcgccuccgggcgggugaccgucagcaccaagcgcagccagcagaccgugaucccgaacaucggcucccggcccugggugcgcggcgucagcuccaagaucagcaucuacuggacgaucgugaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugguggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacgucuaccgggacgaggcgcugaacaaccgcuuccagaucaaggggguggagcucaagagcggcuacaaggacuggauccuguggaucuccuucgccaucagcugcuuccugcugugcaucguccuccugggcuucaucaugugggccugccagaaggggaacauccggugcaacaucugcaucuga

SEQ ID NO: 69791 - RNA, 1701 nt, Artificial Sequence
  derived and/or modified sequence opt1 from hemagglutinin__InfluenzaA__AFJ74727
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcagcugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcuccgggacguacgaccacgacgucuaccgggacgaggcccucaacaaccgcuuccagaucaagggcguggagcucaagagcggcuacaaggacuggauccuguggaucagcuucgccaucuccugcuuccugcugugcguggcccugcucggguucaucaugugggccugccagaagggcaacauccggugcaacaucugcaucuga

SEQ ID NO: 69792 - RNA, 1698 nt, Artificial Sequence; identical to SEQ ID NO: 69786
  derived and/or modified sequence opt1 from hemagglutinin__InfluenzaA__AFJ74743

SEQ ID NO: 69793 - RNA, 1701 nt, Artificial Sequence; identical to SEQ ID NO: 69785
  derived and/or modified sequence opt1 from hemagglutinin__InfluenzaA__AFJ74744

SEQ ID NO: 69794 - RNA, 1698 nt, Artificial Sequence; identical to SEQ ID NO: 69786
  derived and/or modified sequence opt1 from hemagglutinin__InfluenzaA__AFJ74760

SEQ ID NO: 69795 - RNA, 1701 nt, Artificial Sequence
  derived and/or modified sequence opt1 from hemagglutinin__InfluenzaA__AFJ74761
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcagcugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 69796 - RNA, 1698 nt, Artificial Sequence; identical to SEQ ID NO: 69786
  derived and/or modified sequence opt1 from hemagglutinin__InfluenzaA__AFJ74779

SEQ ID NO: 69797 - RNA, 1701 nt, Artificial Sequence; identical to SEQ ID NO: 69785
  derived and/or modified sequence opt1 from hemagglutinin__InfluenzaA__AFJ74780

SEQ ID NO: 69798 - RNA, 1701 nt, Artificial Sequence
  derived and/or modified sequence opt1 from hemagglutinin__InfluenzaA__AFJ74804
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaaccgcaagugggaccuguucguggagcggagcaaggccuacuccaacugcuaccccuacgacgugccggacuacgcgagccugcgcucccucgucgccagcuccgggacgcuggaguucaacaacgagagcuucgacuggaccggcgugacccagaacgggaccuccagcgccugcaagcggcgcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccgcaucaccgugagcacgaagcggucccagcagaccgugaucccgaacaucggcagccgcccccggguccgcgacguguccagccggaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 69799 - RNA, 1701 nt, Artificial Sequence
  derived and/or modified sequence opt1 from hemagglutinin__InfluenzaA__AFJ74819
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucaaccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 69800 - RNA, 1701 nt, Artificial Sequence; identical to SEQ ID NO: 63653
  derived and/or modified sequence opt1 from hemagglutinin__InfluenzaA__AFJ74842

SEQ ID NO: 69801 - RNA, 1698 nt, Artificial Sequence
  derived and/or modified sequence opt1 from hemagglutinin__InfluenzaA__AFJ75036
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggagaacuccuggcccaaccacacggucaccggggugagcgccuccugcagccacaacggcaaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagcgggcccuguaccacaccgagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucaacagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcgucuaccagauccuggccaucuacuccaccguggccagcagccuggugcuccuggucucccugggggccaucagcuucuggaugugcuccaacggcagccuccagugccgcaucugcaucuga

SEQ ID NO: 69802 - RNA, 1701 nt, Artificial Sequence; identical to SEQ ID NO: 61638
  derived and/or modified sequence opt1 from hemagglutinin__InfluenzaA__AFJ75047

SEQ ID NO: 69803 - RNA, 1698 nt, Artificial Sequence
  derived and/or modified sequence opt1 from hemagglutinin__InfluenzaA__AFJ75058
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69804 - RNA, 1698 nt, Artificial Sequence
  derived and/or modified sequence opt1 from hemagglutinin__InfluenzaA__AFJ75069
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaaguccaaccccgagaacgggaccugcuaccccggccacuucgccgacuacgaggagcugcgggagcagcucagcuccgugagcuccuucgagcgcuucgagaucuuccccaaggagagcuccuggccgaaccacacgaccaccggggucagcgccuccugcagccacaacggcgaguccagcuucuacaagaaccugcuguggcucaccgggaagaacggccuguaccccaaccuguccaagagcuacgccaacaacaaggagaaggaggugcucgugcuguggggcguccaccacccgcccaacaucggcgaccagcgggcccuguaccacacggagaacgccuacgugagcguggucuccagccacuacucccgcaaguucacccccgagaucgccaagcggcccaaggugcgcgaccaggagggccggaucaacuacuacuggacccuccuggagcccggggacaccaucaucuucgaggcgaacggcaaccugaucgcgccccgcuacgccuucgcccucagccggggguucggcuccggcaucaucaacagcaacgccccgauggacgagugcgacgccaagugccagacgccccagggggccaucaacuccagccugcccuuccagaacgugcaccccgucaccaucggcgagugcccgaaguacgugcgcuccgccaagcugcggauggugaccgggcuccgcaacauccccagcauccagucccggggccuguucggggccaucgccggcuucaucgagggcggguggaccggcauggucgacgggugguacggcuaccaccaccagaacgagcaggggagcggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggcguguaccagauccuggccaucuacagcaccgucgccuccagccuggugcuccuggugucccugggggccaucagcuucuggaugugcuccaacggcagccuccagugccgcaucugcaucuga

SEQ ID NO: 69805 - RNA, 1701 nt, Artificial Sequence
  derived and/or modified sequence opt1 from hemagglutinin__InfluenzaA__AFJ75091
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagaucagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgaccuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 69806 - RNA, 1701 nt, Artificial Sequence
  derived and/or modified sequence opt1 from hemagglutinin__InfluenzaA__AFJ75449
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggaagaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaccggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 69807 - RNA, 1701 nt, Artificial Sequence
  derived and/or modified sequence opt1 from hemagglutinin__InfluenzaA__AFJ75460
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaacuucgacaagcucuacaucuggggcguccaccaccccgggaccgacaacgaccagaucuuccuguacgcccaggcgagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggaucggccaggccgccgaccugaaguccacccaggccgcggucgaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacguguaccgcgacgaggcgcucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 69808 - RNA, 1698 nt, Artificial Sequence
  derived and/or modified sequence opt1 from hemagglutinin__InfluenzaA__AFJ75517
augaaggugaagcugcucguccugcugugcaccuucaccgccacguacgccgacaccaucugcaucggcuaccacgcgaacaacagcaccgacaccguggacacggugcucgagaagaacgucaccgugaccuacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaagaagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucaaccgcggguucggcagcggcaucaucaacuccaacgcccccauggacgagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagacccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgcgagaagaucgacggcgucaagcucgaguccaugggcguguaccagauccuggcgaucuacagcaccguggccuccagccugguccuccuggugagccugggggccaucuccuucuggaugugcagcaacggcucccuccagugccggaucugcaucuga

SEQ ID NO: 69809 - RNA, 1698 nt, Artificial Sequence
  derived and/or modified sequence opt1 from hemagglutinin__InfluenzaA__AFJ75560
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacgagugcgacgccaagugccagacgccccagggggcgaucaacuccagccugcccuuccagaacguccacccggugaccaucggcgagugccccaaguucgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugcgcaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgucaagcucgagagcaugggcguguaccagauccuggcgaucuacuccaccguggccagcagccugguccuccuggugucccugggggccaucagcuucuggaugugcuccaacggcagccuccagugccgcaucugcaucuga

SEQ ID NO: 69810 - RNA, 1698 nt, Artificial Sequence
  derived and/or modified sequence opt1 from hemagglutinin__InfluenzaA__AFJ75571
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgagaacuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaugacccuguaccacaaggagaacgccuacgugagcgucguguccagccacuacagccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacgagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgcgagcggaucgacggcgucaagcucgaguccaugggcguguaccagauccuggcgaucuacagcaccguggccuccagccugguccuccuggugagccugggggccaucuccuucuggaugugcagcaacggcucccuccagugccgcaucugcaucuga

SEQ ID NO: 69811 - RNA, 1701 nt, Artificial Sequence
  derived and/or modified sequence opt1 from hemagglutinin__InfluenzaA__AFJ75593
augaagaccaucaucgcccugagcuacauccucugccugguguucgcccagaagcugcccggcaacgacuccagcaccgcgacgcucugccuggggcaccacgccgucccgaacggcaccaucgugaagaccaucaccaacgaccagaucgaggugacgaacgccaccgagcugguccaguccagcuccaccggggagaucugcaacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagguggaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 69812 - RNA, 1698 nt, Artificial Sequence
  derived and/or modified sequence opt1 from hemagglutinin__InfluenzaA__AFJ75615
augaaggugaagcugcucguccugcugugcaccuucaccgccacguacgccgacaccaucugcgugggcuaccacgcgaacaacagcaccgacaccguggacacgguccucgagaagaacgugaccgugacccacuccgucaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccagcugcucccacaacggcgagagcuccuucuaccgcaaccugcuguggcucaccgggaagaacggccuguaccccaaccugagcaaguccuacgccaacaacaaggagaaggagguccucgugcuguggggcgugcaccacccgcccaacaucggcgaccagaaggcccuguaccacaccgagaacgccuacgucagcguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgaggucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggcgaucuacagcaccguggccagcucccugguccuccuggugagccugggggccaucuccuucuggaugugcagcaacggcucccuccagugccggaucugcaucuga

SEQ ID NO: 69813 - RNA, 1701 nt, Artificial Sequence; identical to SEQ ID NO: 66360
  derived and/or modified sequence opt1 from hemagglutinin__InfluenzaA__AFJ75630

SEQ ID NO: 69814 - RNA, 1701 nt, Artificial Sequence; identical to SEQ ID NO: 66360
  derived and/or modified sequence opt1 from hemagglutinin__InfluenzaA__AFJ75641

SEQ ID NO: 69815 - RNA, 1698 nt, Artificial Sequence
  derived and/or modified sequence opt1 from hemagglutinin__InfluenzaA__AFJ75651
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccggaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccgacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69816 - RNA, 1701 nt, Artificial Sequence
  derived and/or modified sequence opt1 from hemagglutinin__InfluenzaA__AFJ75662
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69817 - RNA, 1698 nt, Artificial Sequence
  derived and/or modified sequence opt1 from hemagglutinin__InfluenzaA__AFJ75673
augaaggugaagcugcucguccugcugugcaccuucaccgccacguacgccgacaccaucugcaucggcuaccacgcgaacaacagcaccgacaccguggacacggugcucgagaagaacgucaccgugaccuacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucaaccgcggguucggcagcggcaucaucaacuccaacgcccccauggacgagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagacccagcugaagaacaacgccaaggagaucgggaacggcugcuucgaguucuaccacaagugcaacgacgagugcauggaguccgugaagaacgggaccuacgacuaccccaaguacagcgaggaguccaagcugagccgcgagaagaucgacggcgucaagcucgaguccaugggcguguaccagauccuggcgaucuacagcaccguggccuccagccugguccuccuggugagccugggggccaucuccuucuggaugugcagcaacggcucccuccagugccggaucugcaucuga

SEQ ID NO: 69818 - RNA, 1701 nt, Artificial Sequence; identical to SEQ ID NO: 63677
  derived and/or modified sequence opt1 from hemagglutinin__InfluenzaA__AFJ76119

SEQ ID NO: 69819 - RNA, 1701 nt, Artificial Sequence; identical to SEQ ID NO: 64030
  derived and/or modified sequence opt1 from hemagglutinin__InfluenzaA__AFJ76131

SEQ ID NO: 69820 - RNA, 1701 nt, Artificial Sequence
  derived and/or modified sequence opt1 from hemagglutinin__InfluenzaA__AFJ76155
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggagcaggagggccgcaugaacuacuacuggacccuggucgagcccggggacaagaucaccuucgaggcgaccggcaaccucguggugccccgguacgccuucgccauggagcgcaaggccggguccggcaucaucaucagcgacacgcccguccacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuacccgaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 69821 - RNA, 1698 nt, Artificial Sequence
  derived and/or modified sequence opt1 from hemagglutinin__InfluenzaA__AFJ76186
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucaccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccgacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 69822 - RNA, 1701 nt, Artificial Sequence; identical to SEQ ID NO: 63677
  derived and/or modified sequence opt1 from hemagglutinin__InfluenzaA__AFJ76203

SEQ ID NO: 69823 - RNA, 1701 nt, Artificial Sequence
  derived and/or modified sequence opt1 from hemagglutinin__InfluenzaA__AFJ76213
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcacagcaaguacaaguaccccgcccugaacgugaccaugcccaacaacgagaaguucgacaagcuguacaucuggggcguccaccaccccgggaccgacuccgaccagaucagccucuacgcgcaggccagcggccggaucaccguguccacgaagcgcagccagcagaccgugaucccgaacaucggcucccggccccgcguccgggacgugagcucccgcaucagcaucuacuggaccaucgugaagcccggggacauccugcugaucaacuccaccggcaaccucaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcuggccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccucaaguccacccaggcggccaucaaccagaucaacggcaagcugaaccggcugaucggcaagaccaacgagaaguuccaccagaucgagaaggaguucagcgagguggaggggcgcauccaggaccucgagaaguacguggaggacacgaagaucgaccugugguccuacaacgccgagcugcucgucgcccuggagaaccagcacaccaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggacguacgaccacgacguguaccgggacgaggcccugaacaaccgcuuccagaucaagggcguggagcucaagagcggcuacaaggacuggauccuguggaucagcuucgccaucuccugcuuccugcucugcgucgcccugcugggguucaucaugugggccugccagaagggcaacauccggugcaacaucugcaucuga

SEQ ID NO: 69824 - RNA, 1701 nt, Artificial Sequence
  derived and/or modified sequence opt1 from hemagglutinin__InfluenzaA__AFJ77408
augaagaccaucaucgcccugagcuacauccucugccugaucuucgcccagaagcugcccggcaacgacaacuccaccgcgacgcucugccuggggcaccacgccgugccgaacggcacccuggucaagaccaucaccaacgaccagaucgaggugacgaacgccaccgagcucgugcagagcuccagcaccgggcgcaucugcaacagcccccaccggauccuggacggcgagaacugcacccugaucgacgcccuccugggggacccccacugcgacggcuuccagaacaaggagugggaccuguucgucgagcgcagcaaggccuacuccaacugcuaccccuacgacgugccggacuacgcgagccuccggucccugguggccagcuccggcacgcuggaguucaccaaggagggguucaacuggaccggcgucgcccaggacgggaaguccuacuccugcaagcgcggcagcgugaacuccuucuucagccggcucaacuggcugcacaagcuggaguacaaguaccccgcccucaacgugaccaugcccaacaacgacaaguucgacaagcuguacaucuggggcguccaccaccccuccacggacagcgaccagaccucccuguacgugcaggcgagcgggcgcgugaccgucagcaccaagcggucccagcagacggugaucccgaacaucggcagccgccccugggugcgggggaucuccagccgcaucuccaucuacuggaccaucgucaagcccggcgacauccuccugaucaacagcaccgggaaccugaucgcgccccggggcuacuucaagauccgcaacggcaaguccagcaucaugcgguccgacgccccgaucgggaacugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggcuucaucgagaacgggugggagggcaugguggacgggugguacggcuuccgccaccagaacagcgaggggacgggccaggccgccgaccugaaguccacccaggccgcgaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacaugggcaacgggugcuucaagaucuaccacaagugcgacaacgccugcaucggcuccauccggaacgggaccuacgaccacgacguguaccgcgacgaggcgcugaacaaccgguuccagaucaagggcgucgagcucaagagcggcuacaaggacuggauccuguggaucuccuucgccaucagcugcuuccugcugugcgugguccuccugggguucaucaugugggccugccagaagggcaacauccgcugcaacaucugcaucuga

SEQ ID NO: 69825 - RNA, 1701 nt, Artificial Sequence
  derived and/or modified sequence opt1 from hemagglutinin__InfluenzaA__AFJ77430
augaagaccaucaucgcccugagcuacauccucugccugaucuucgcccagaagcugcccggcaacgacaacuccaccgcgacgcucugccuggggcaccacgccgugccgaacggcacccuggucaagaccaucaccaacgaccagaucgaggugacgaacgccaccgagcucgugcagagcuccagcaccgggcgcaucugcgacagcccccaccggauccuggacggcgagaacugcacccugaucgacgcccuccugggggaccccaacugcgacggcuuccagaacaaggagugggaccuguucgucgagcgcagcaaggccuacuccaacugcuaccccuacgacgugccggacuacgcgagccuccggucccugguggccagcuccggcacgcuggaguucaccaaggagggguucaacuggaccggcgucgcccaggacgggaaguccuacuccugcaagcgcggcagcgugaacuccuucuucagccggcucaacuggcugcacaagcuggaguacaaguaccccgcccucaacgugaccaugcccaacaacgacaaguucgacaagcuguacaucuggggcguccaccaccccuccacggacagcgaccagaucucccuguacgcgcaggccagcgggcgcgugaccgugagcaccaagcggucccagcagaccgucaucccgaacaucggcagccgccccugggugcgggggaucuccagccgcaucuccaucuacuggacgaucgugaagcccggcgacauccuccugaucaacagcaccgggaaccugaucgcgccccggggcuacuucaagauccgcaacggcaaguccagcaucaugcgguccgacgccccgaucgggaacugcaacagcgagugcaucacccccaacggcuccauccccaacgacaagcccuuccagaacgucaaccgcaucaccuacggggccugcccgcgguacgugaagcagaacacgcucaagcuggccaccggcaugcgcaacgugcccgagaagcagacccgggggaucuucggcgccaucgccggcuucaucgagaacgggugggagggcauggucgacgggugguacggcuuccgccaccagaacagcgaggggaccggccaggccgccgaccugaaguccacgcaggcggccaucaaccagaucaacggcaagcucaaccggcugaucgagaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacaccaucgaccugacggacagcgagaugaacaagcuguucgagcggacccgccgccagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcguggagcucaagagcggcuacaaggacuggauccuguggaucuccuucgccaucagcugcuuccugcugugcgucgugcuccugggguucaucaugugggccugccagaagggcaacauccggugcaacaucugcaucuga

SEQ ID NO: 69826 - RNA, 1701 nt, Artificial Sequence
  derived and/or modified sequence opt1 from hemagglutinin__InfluenzaA__AFJ77440
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccagcgagggguucaacuggaccggcguggcccaggacgggaccuccuacgccugcaagcgcggcagcgugaaguccuucuucagccggcucaacuggcugcacaagcuggaguacaaguaccccgcgcucaacgucacgaugcccaacaacgacaaguucgacaagcuguacaucuggggcgugcaccaccccuccaccgacagcgaccagaccucccuguacgugcaggccagcgggcgcgucaccgugagcacgaagcggucccagcagaccgugaucccgaacaucggcagccgccccuggguccgcgggguguccagccggaucuccaucuacuggaccaucgugaagcccggcgacauccuccugaucaacagcaccgggaaccugaucgcgccccggggcuacuucaagauccgcuccggcaagagcuccaucaugcggagcgacgccccgaucgggaacugcaacuccgagugcaucacgcccaacggcagcauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccugaaguccacccaggcggccaucaaccagaucaacggcaagcucaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggacguacgaccacgacguguaccgcgacgaggcccugaacaaccgguuccagaucaagggcgucgagcugaaguccggcuacaaggacuggauccucuggaucagcuucgccaucagcugcuuccugcugugcguggugcuccugggguucaucaugugggccugccagaagggcaacauccgcugcaacaucugcaucuga

SEQ ID NO: 69827 - RNA, 1701 nt, Artificial Sequence
  derived and/or modified sequence opt1 from hemagglutinin__InfluenzaA__AFJ77451
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcgugaaguccuucuucagccgccucaacuggcugcacaagcuggaguacaaguaccccgcgcucaacgucaccaugcccaacaacgacaaguucgacaagcuguacaucuggggcgugcaccaccccuccacggacagcgaccagaccucccuguacgugcaggccagcgggcgggucaccgugagcaccaagcgcucccagcagacggugaucccgaacaucgggagccggcccuggguccgcggcguguccagccggaucuccaucuacuggaccaucgugaagcccggcgacauccuccugaucaacagcaccgggaaccugaucgcgccccgcggcuacuucaagauccgguccgggaaguccuccaucaugcgcagcgacgccccgaucggcaacugcaacuccgagugcaucacccccaacggcagcauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucgagaagaccaacggcaaguuccaccagaucgagaaggaguucuccgagguggagggccggauccaggaccuggagaaguacguggaggacaccaagaucgaccucuggagcuacaacgccgagcugcuggucgcccucgagaaccagcacacgaucgaccugaccgacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggcuucaucaugugggccugccagaaggggaacauccggugcaacaucugcaucuga

SEQ ID NO: 69828 - RNA, 1701 nt, Artificial Sequence
  derived and/or modified sequence opt1 from hemagglutinin__InfluenzaA__AFJ77462
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucagcgagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagagcggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 69829 - RNA, 1701 nt, Artificial Sequence
  derived and/or modified sequence opt1 from hemagglutinin__InfluenzaA__AFJ77473
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgcgagccugcgcucccucgucgccagcuccggcacgcuggaguucaacaacgagagcuucaacuggaccgggguggcccagaacggcaccuccagcgccugcaagcggcgcuccaucaagagcuucuucucccggcugaacuggcuccaccagcugaaguacaaguaccccgcgcugaacgugaccaugcccaacaacgagaaguucgacaagcucuacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcugaagcucgccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcaacaucugcaucuga

SEQ ID NO: 69830 - RNA, 1701 nt, Artificial Sequence; identical to SEQ ID NO: 61194
  derived and/or modified sequence opt1 from hemagglutinin__InfluenzaA__AFJ77484

SEQ ID NO: 69831 - RNA, 1701 nt, Artificial Sequence; identical to SEQ ID NO: 61196
  derived and/or modified sequence opt1 from hemagglutinin__InfluenzaA__AFJ77495

SEQ ID NO: 69832 - RNA, 1701 nt, Artificial Sequence; identical to SEQ ID NO: 61194
  derived and/or modified sequence opt1 from hemagglutinin__InfluenzaA__AFJ77506

SEQ ID NO: 69833 - RNA, 1701 nt, Artificial Sequence
  derived and/or modified sequence opt1 from hemagglutinin__InfluenzaA__AFJ77517
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccaacgccugcaagcgccggagcaugaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccagaccucccuguacgcccaggccagcgggcgggugaccgugagcacccagcgcucccagcagacggucaucccgaacaucgggagccggcccugggugcgcggcguguccagccggaucuccaucuacuggaccaucgucaagcccggcgacauccugcucaucaacagcaccgggaaccugaucgcgccccgcggcuacuucaagauccgguccgggaaguccuccaucauccgcagcgacgccccgaucggcaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaugagcugcuuccuccugugcgugguccugcucggcuucaucaugugggccugccagaagggcaacauccggugcaacaucugcaucuga

SEQ ID NO: 69834 - RNA, 1701 nt, Artificial Sequence; identical to SEQ ID NO: 61031
  derived and/or modified sequence opt1 from hemagglutinin__InfluenzaA__AFJ77528

SEQ ID NO: 69835 - RNA, 1698 nt, Artificial Sequence
  derived and/or modified sequence opt1 from hemagglutinin__InfluenzaA__AFJ77550
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgcgagccugcgcucccucgucgccagcuccggcacgcuggaguucaacaacgagagcuucaacuggaccgggguggcccagaacggcaccuccagcgccugcaagcggcgcuccaucaagagcuucuucucccggcugaacuggcuccaccagcugaaguacaaguaccccgcgcugaacgugaccaugcccaacaacgagaaguucgacaagcucuacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcugaagcucgccaccggcaugcgcaacguccccgagaagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcagcaucugcaucuga

SEQ ID NO: 69836 - RNA, 1701 nt, Artificial Sequence
  derived and/or modified sequence opt1 from hemagglutinin__InfluenzaA__AFJ77561
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcgugaaguccuucuucagccgccucaacuggcugcacaagcuggaguacaaguaccccgcgcucaacgucaccaugcccaacaacgacaaguucgacaagcuguacaucuggggcgugcaccaccccuccacggacagcgaccagaccucccuguacgcccaggccagcgggcgggugaccgucagcaccaagcgcucccagcagacggugaucccgaacaucgggagccggcccugggugcgcggcgucuccagccggaucuccaucuacuggaccaucgugaagcccggcgacauccuccugaucuacagcaccgggaaccugaucgcgccccgcggcuacuucaagauccgguccgggaaguccuccaucaugcgcagcgacgccccgaucggcaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucagcuucgccaucuccugcuuccugcugugcgucgugcuccugggcuucaucaugugggccugccagaagggcaacauccggugcaacaucugcaucuga

SEQ ID NO: 69837 - RNA, 1698 nt, Artificial Sequence
  derived and/or modified sequence opt1 from hemagglutinin__InfluenzaA__AFJ77572
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgcgagccugcgcucccucgucgccagcuccggcacgcuggaguucaacaacgagagcuucaacuggaccgggguggcccagaacggcaccuccagcgccugcaagcggcgcuccaucaagagcuucuucucccggcugaacuggcuccaccagcugaaguacaaguaccccgcgcugaacgugaccaugcccaacaacgagaaguucgacaagcucuacaucuggggcguccaccaccccagcacggacuccgaccagaucagccuguacgcccaggccagcgggcgcgugaccguguccaccaagcggagccagcagaccgucaucccgaacaucggguccggccccugggugcgcggcgugagcucccggaucagcaucuacuggacgaucgucaagcccggggacauccugcucaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcugaagcucgccaccgggaugcggaacguccccgagaagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagcgcaccaagaagcagcugcgggagaacgcggaggacauggggaacggcugcuucaagaucuaccacaagugcgacaacgccugcaucggguccauccgcaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggccugccagaaggggaacauccgcugcagcaucugcaucuga

SEQ ID NO: 69838 - RNA, 1701 nt, Artificial Sequence
  derived and/or modified sequence opt1 from hemagglutinin__InfluenzaA__AFJ77583
augaagaccaucaucacccugagcuacauccucugccugguguucgcccagaagcugcccgucaaggacaacuccacggccacccucugccugggccaccacgcggugccgaacgggacccuggugaagaccaucacgaacgaccacaucgaggucaccaacgccaccgagcucgugcagagcuccagcaccggccgcaucugcgacagcccccaccagauccuggacggggagaacugcacgcugaucgacgcccuccugggcgacccccacugcgacggguuccagaacaaggagugggaccuguucguggagcggagcaccgccuacuccaacugcuaccccuacgacgucccggacuacgccagccuccgcucccugguggcgagcuccggcacccuggaguucaacaacgagagcuucaacuggaccggcguggcccagaacgggacguccagcgccugcaagcggcgcuccaucaagagcuucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucagccuguacgcgcaggccagcgggcgcgugaccgucuccacgaagcggagccagcagaccgugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacgggugggagggcaugguggacggcugguacggguuccgccaccagaacagcgagggcaccgggcaggccgccgaccugaaguccacccaggcggccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcacguacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 69839 - RNA, 1701 nt, Artificial Sequence
  derived and/or modified sequence opt1 from hemagglutinin__InfluenzaA__AFJ77594
augaagaccaucaucgcccugagcuacauccucugccugguguucgcccagaagcugcccgucaaggacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 69840 - RNA, 1701 nt, Artificial Sequence
  derived and/or modified sequence opt1 from hemagglutinin__InfluenzaA__AFJ77605
augaagaccaucaucgcccugagcuacauccucugccugaucuucgcccagaagcugcccggcaacgacaacuccaccgcgacgcucugccuggggcaccacgccgugccgaacggcacccuggucaagaccaucaccaacgaccagaucgaggugacgaacgccaccgagcucgugcagagcuccagcaccgggaagaucugcgacagcccccaccagauccuggacggcgagaacugcacccugaucgacgcccuccugggggacccccacugcgacggcuuccagaacaaggagugggaccuguucgucgagcgcagcaaggccuacuccaacugcuaccccuacgacgugccggacuacgcgagccuccggucccugguggccagcuccggcacgcuggaguucaacaacgagagcuucaacuggaccggggucgcccagaacggcaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcgugcaccaccccagcacggacuccgaccagaucagccuguacgcccaggccagcgggcgggucaccguguccaccaagcgcagccagcagaccgugaucccgaacaucgggucccggcccuggguccgcggcgugagcucccggaucagcaucuacuggacgaucgugaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcucaagcuggccaccggcaugcggaacgugcccgagaagcagacccgcgggaucuucggcgccaucgccggguucaucgagaacggcugggagggcauggucgacgggugguacggcuuccggcaccagaacagcgaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugacggacagcgagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggccgugaacaaccgguuccagaucaagggcgucgagcugaaguccggguacaaggacuggauccuguggaucagcuucgccaucuccugcuuccuccugugcgugguccugcucggcuucaucaugugggccugccagaagggcaacauccgcugcaacaucugcaucuga

SEQ ID NO: 69841 - RNA, 1701 nt, Artificial Sequence
  derived and/or modified sequence opt1 from hemagglutinin__InfluenzaA__AFJ77616
augaagaccaucaucgcccugagcuacauccucugcauggugcuggcccagaagcugcccgucaaggacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccagcaucgggaagugcaacuccgagugcaucaccccgaacggcagcauccccaacgacaagcccuuccagaacgugaaccgcaucacguacggcgccugcccccgguacgucaagcagaacacccucaagcuggccaccgggaugcgcaacgugccggagaagcagacccggggcaucuucggggccaucgccggcuucaucgagaacgggugggagggcaugguggacggcugguacggguuccgccaccagaacuccgagggcacggggcaggccgcggaccugaaguccacccaggccgccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggagcauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 69842 - RNA, 1701 nt, Artificial Sequence
  derived and/or modified sequence opt1 from hemagglutinin__InfluenzaA__AFJ77627
augaagaccaucaucgcccugagcuacauccucugccuggugcuggcccagaagcuccccgucaaggacaacuccaccgcgacgcugugccugggccaccacgccgugccgaacgggacccucgugaagaccaucaccaacgaccacaucgaggucacgaacgccaccgagcuggugcagagcuccagcaccggccgcaucugcgacagcccccaccagauccuggacggggagaacugcacccucaucgacgcccugcugggcgacccccacugcgacggguuccagaacaaggagugggaccucuucguggagcgguccacggccuacuccaacugcuaccccuacgacgucccggacuacgcgagccugcgcucccugguggccagcuccggcacccucgaguucaacaacgagagcuucaacuggaccggcguggcccagaacgggaccuccagcgccugcaagcggcgcuccaucaagagcuucuucucccggcugaacuggcugcaccagcucaaguacaaguaccccgcgcugaacgucacgaugcccaacaacgagaaguucgacaagcuguacaucuggggcgugcaccaccccagcaccgacuccgaccagaucagccucuacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccugcugaucaacuccaccggcaaccucaucgcgccccggggguacuucaagauccgcagcggcaaguccagcaucaugcgguccaacgccagcaucgggaagugcaacuccgagugcaucaccccgaacggcagcauccccaacgacaagcccuuccagaacgugaaccgcaucacguacggcgccugcccccgguacgucaagcagaacacccugaagcuggccaccgggaugcgcaacgugccggagaagcagacccggggcaucuucggggccaucgccggcuucaucgagaacgggugggagggcaugguggacggcugguacggguuccgccaccagaacuccgagggcacggggcaggccgcggaccucaagagcacccaggccgccaucaaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggagcauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 69843 - RNA, 1701 nt, Artificial Sequence
  derived and/or modified sequence opt1 from hemagglutinin__InfluenzaA__AFJ77638
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaccacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacagcgagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 69844 - RNA, 1701 nt, Artificial Sequence
  derived and/or modified sequence opt1 from hemagglutinin__InfluenzaA__AFJ77649
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacaacaccgggaaccugaucgcgccccggggcuacuucaagauccgcaacgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuucaagaucaagggggucgagcugaaguccggcuacaaggacuggauccucuggaucuccuucgccaucagcugcuuccugcugugcgugguccuccugggcuucaucaugugggccugccagaaggggaacauccggugcaacaucugcaucuga

SEQ ID NO: 69845 - RNA, 1701 nt, Artificial Sequence; identical to SEQ ID NO: 61211
  derived and/or modified sequence opt1 from hemagglutinin__InfluenzaA__AFJ77660

SEQ ID NO: 69846 - RNA, 1701 nt, Artificial Sequence; identical to SEQ ID NO: 61211
  derived and/or modified sequence opt1 from hemagglutinin__InfluenzaA__AFJ77671

SEQ ID NO: 69847 - RNA, 1701 nt, Artificial Sequence; identical to SEQ ID NO: 61211
  derived and/or modified sequence opt1 from hemagglutinin__InfluenzaA__AFJ77682

SEQ ID NO: 69848 - RNA, 1701 nt, Artificial Sequence
  derived and/or modified sequence opt1 from hemagglutinin__InfluenzaA__AFJ77693
augaagaccaucaucgcccugagcuacauccucugccugguguucgcccagaagcugcccgucaacgacaacuccaccgcgacgcucugccugggccaccacaccgugccgaacgggacccuggugaagaccaucacgaacgacaacaucgaggucaccaacgccaccgagcucgugcagagcuccagcaccggccgcaucugcgacagcccccaccagauccuggacggggagaacugcacgcugaucgacgcccuccugggcgacccccacugcgacggguuccagaacaaggagugggaccuguucguggagcggagcaccgccuacuccaacugcuaccccuacgacgucccggacuacgccagccuccgcucccugguggcgagcuccggcacccuggaguucaacaacgagagcuucaacuggaccggcguggaccagaacgggacguccagcgccugcaagcggcgcuccaacaagagcuucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucagccuguacgcccaggcgagcgggcgcgugaccgucuccacgaagcggagccagcagaccgugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacgcccaacggcuccauccccaacgacaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacgggugggagggcaugguggacggcugguacggguuccgccaccagaacuucgagggcaccgggcaggccgccgaccugaaguccacccaggccgcgaucaaccagaucaacggcaagcucaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacggcugcuucaagaucuaccacaagugcgacaacgccugcaucgggagcauccggaacggcacguacgaccacgacgucuaccgcgacgaggcgcugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 69849 - RNA, 1701 nt, Artificial Sequence; identical to SEQ ID NO: 61211
  derived and/or modified sequence opt1 from hemagglutinin__InfluenzaA__AFJ77704

SEQ ID NO: 69850 - RNA, 1701 nt, Artificial Sequence; identical to SEQ ID NO: 69689
  derived and/or modified sequence opt1 from hemagglutinin__InfluenzaA__AFJ77715

SEQ ID NO: 69851 - RNA, 1701 nt, Artificial Sequence; identical to SEQ ID NO: 69689
  derived and/or modified sequence opt1 from hemagglutinin__InfluenzaA__AFJ77726

SEQ ID NO: 69852 - RNA, 1701 nt, Artificial Sequence; identical to SEQ ID NO: 69785
  derived and/or modified sequence opt1 from hemagglutinin__InfluenzaA__AFJ77737

SEQ ID NO: 69853 - RNA, 1701 nt, Artificial Sequence; identical to SEQ ID NO: 61040
  derived and/or modified sequence opt1 from hemagglutinin__InfluenzaA__AFJ77748

SEQ ID NO: 69854 - RNA, 1701 nt, Artificial Sequence; identical to SEQ ID NO: 61040
  derived and/or modified sequence opt1 from hemagglutinin__InfluenzaA__AFJ77759

SEQ ID NO: 69855 - RNA, 1701 nt, Artificial Sequence
  derived and/or modified sequence opt1 from hemagglutinin__InfluenzaA__AFJ77781
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacagcgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccagcggccggaucaccguguccacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69856 - RNA, 1701 nt, Artificial Sequence; identical to SEQ ID NO: 62803
  derived and/or modified sequence opt1 from hemagglutinin__InfluenzaA__AFJ77792

SEQ ID NO: 69857 - RNA, 1701 nt, Artificial Sequence; identical to SEQ ID NO: 62803
  derived and/or modified sequence opt1 from hemagglutinin__InfluenzaA__AFJ77803

SEQ ID NO: 69858 - RNA, 1701 nt, Artificial Sequence; identical to SEQ ID NO: 62803
  derived and/or modified sequence opt1 from hemagglutinin__InfluenzaA__AFJ77814

SEQ ID NO: 69859 - RNA, 1701 nt, Artificial Sequence; identical to SEQ ID NO: 62803
  derived and/or modified sequence opt1 from hemagglutinin__InfluenzaA__AFJ77825

SEQ ID NO: 69860 - RNA, 1701 nt, Artificial Sequence; identical to SEQ ID NO: 62803
  derived and/or modified sequence opt1 from hemagglutinin__InfluenzaA__AFJ77836

SEQ ID NO: 69861 - RNA, 1701 nt, Artificial Sequence; identical to SEQ ID NO: 62803
  derived and/or modified sequence opt1 from hemagglutinin__InfluenzaA__AFJ77847

SEQ ID NO: 69862 - RNA, 1701 nt, Artificial Sequence
  derived and/or modified sequence opt1 from hemagglutinin__InfluenzaA__AFJ77858
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgcagcgcagccagcagaccgugaucccgaacaucggcucccggccccgcguccgggacauccccagccgcaucuccaucuacuggaccaucgugaagcccggggacaugcugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaacaagcucaucggcaagaccaacgagaaguuccaccagaucgagaaggaguucuccgaggucgaggggcggauccaggaccuggagaaguacguggaggacacgaagaucgaccuguggagcuacaacgccgagcuccugguggcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacgucuaccgcgacgaggcccucaacaaccgguuccagaucaagggcguggagcugaaguccggcuacaaggacuggauccuguggaucagcuucgccaucuccugcuuccucuucugcguggcccugcugggguucaucaugugggccugccagaagggcaacauccgcugcaacaucugcaucuga

SEQ ID NO: 69863 - RNA, 1701 nt, Artificial Sequence
  derived and/or modified sequence opt1 from hemagglutinin__InfluenzaA__AFJ77869
augaagaccaucaucgccuucagcuacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucagccucuacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 69864 - RNA, 1701 nt, Artificial Sequence
  derived and/or modified sequence opt1 from hemagglutinin__InfluenzaA__AFJ77880
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69865 - RNA, 1701 nt, Artificial Sequence
  derived and/or modified sequence opt1 from hemagglutinin__InfluenzaA__AFJ77902
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucggccuguacgcgcaggccagcggccggaucaccguguccacgaagcgcagccagcagaccgugaucccgaacaucgggagccggccccgcguccgggacauccccucccgcaucagcaucuacuggaccaucgugaagcccggcgacaugcugcucaucaacuccaccgggaaccugaucgccccgcggggcuacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucaaccagaucaacggcaagcugaaccggcucaucgggaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggccugccagaaggggaacauccggugcaacaucugcaucuga

SEQ ID NO: 69866 - RNA, 1701 nt, Artificial Sequence
  derived and/or modified sequence opt1 from hemagglutinin__InfluenzaA__AFJ77913
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugcaggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguacccggcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugauccccaacaucggcucccggccgcgcguccgggacauccccagccgcaucuccaucuacuggaccaucgugaagcccggggacaugcugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 69867 - RNA, 1701 nt, Artificial Sequence; identical to SEQ ID NO: 62121
  derived and/or modified sequence opt1 from hemagglutinin__InfluenzaA__AFJ77924

SEQ ID NO: 69868 - RNA, 1701 nt, Artificial Sequence
  derived and/or modified sequence opt1 from hemagglutinin__InfluenzaA__AFJ77935
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccgggggcaucugcgacagcccccaccagauccucgacggggagaacugcacccugauggacgcccugcucggcgacccccagugcgacggcuuccagaacaagaagugggaccuguucguggagcgcagcaaggccuacuccaacugcuaccccuacgacgucccggaccacgcgagccugcggucccucguggccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaccuucgacaagcucuacaucuggggcgugcaccaccccgggaccgacaacgaccagaucagccuguacgcgcaggccuccggccggaucacggugagcaccaagcgcagccagcagaccgucaucccgaacaucggcucccggccccgcgugcgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgucaaccgcaucaccuacggcgccugcccccgguacgugaagcagaacacccugaagcucgcgacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 69869 - RNA, 1701 nt, Artificial Sequence
  derived and/or modified sequence opt1 from hemagglutinin__InfluenzaA__AFJ77946
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacaugcugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacaucaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggaucaucuggaucagcuucgccaucuccugcuuccugcucugcguggcccugcugggguucaucaugugggccugccagaagggcaacauccggugcaacaucugcaucuga

SEQ ID NO: 69870 - RNA, 1701 nt, Artificial Sequence; identical to SEQ ID NO: 62761
  derived and/or modified sequence opt1 from hemagglutinin__InfluenzaA__AFJ77957

SEQ ID NO: 69871 - RNA, 1701 nt, Artificial Sequence; identical to SEQ ID NO: 61638
  derived and/or modified sequence opt1 from hemagglutinin__InfluenzaA__AFJ77968

SEQ ID NO: 69872 - RNA, 1701 nt, Artificial Sequence
  derived and/or modified sequence opt1 from hemagglutinin__InfluenzaA__AFJ77979
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugcggagcggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69873 - RNA, 1701 nt, Artificial Sequence
  derived and/or modified sequence opt1 from hemagglutinin__InfluenzaA__AFJ77990
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgaguaccgggacgaggcccucaacaaccgcuuccagaucaagggcgucgagcugaaguccggcuacaaggacuggauccuguggaucuccuucgccaucagcugcuuccuccugugcgugacgcugcucggguucaucaugugggccugccagaagggcaacauccggugcaacaucugcaucuga

SEQ ID NO: 69874 - RNA, 1701 nt, Artificial Sequence
  derived and/or modified sequence opt1 from hemagglutinin__InfluenzaA__AFJ78001
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacgggaagaacugcacccugaucgacgcccugcucggcgacccccagugcgacgacuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugacgcugcucggcuucaucaugugggccugccagaaggggaacauccggugcaacaucugcaucuga

SEQ ID NO: 69875 - RNA, 1701 nt, Artificial Sequence
  derived and/or modified sequence opt1 from hemagglutinin__InfluenzaA__AFJ78012
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 69876 - RNA, 1701 nt, Artificial Sequence
  derived and/or modified sequence opt1 from hemagglutinin__InfluenzaA__AFJ78023
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69877 - RNA, 1701 nt, Artificial Sequence; identical to SEQ ID NO: 61638
  derived and/or modified sequence opt1 from hemagglutinin__InfluenzaA__AFJ78034

SEQ ID NO: 69878 - RNA, 1701 nt, Artificial Sequence
  derived and/or modified sequence opt1 from hemagglutinin__InfluenzaA__AFJ78045
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagccgggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcauggggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacaucaagugcaacaucugcaucuga

SEQ ID NO: 69879 - RNA, 1701 nt, Artificial Sequence; identical to SEQ ID NO: 61638
  derived and/or modified sequence opt1 from hemagglutinin__InfluenzaA__AFJ78056

SEQ ID NO: 69880 - RNA, 1701 nt, Artificial Sequence
  derived and/or modified sequence opt1 from hemagglutinin__InfluenzaA__AFJ78067
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggccgguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69881 - RNA, 1701 nt, Artificial Sequence
  derived and/or modified sequence opt1 from hemagglutinin__InfluenzaA__AFJ78078
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucgacaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69882 - RNA, 1701 nt, Artificial Sequence; identical to SEQ ID NO: 69805
  derived and/or modified sequence opt1 from hemagglutinin__InfluenzaA__AFJ78089

SEQ ID NO: 69883 - RNA, 1701 nt, Artificial Sequence; identical to SEQ ID NO: 62836
  derived and/or modified sequence opt1 from hemagglutinin__InfluenzaA__AFJ78100

SEQ ID NO: 69884 - RNA, 1701 nt, Artificial Sequence
  derived and/or modified sequence opt1 from hemagglutinin__InfluenzaA__AFJ78111
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaacuucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 69885 - RNA, 1701 nt, Artificial Sequence
  derived and/or modified sequence opt1 from hemagglutinin__InfluenzaA__AFJ78122
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcggccggaucaccgucuccacgaagcgcagccagcagaccgugaucccgaacaucggcagccggccccgcgugcggaacauccccucccgcaucagcaucuacuggaccaucgucaagcccggggacauccugcucaucaacuccaccggcaaccugaucgccccgcggggguacuucaagauccgcagcggccgguccagcaucaugcgcuccgacgcccccaucgacaagugcaacagcgagugcaucacgcccaacggcuccauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucauccggaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcugaaguccggguacaaggacuggauccuguggaucuccuucgccaucagcugcuuccuccugugcguggcccugcucggcuucaucaugugggccugccagaagggcaacauccgcugcaacaucugcaucuga

SEQ ID NO: 69886 - RNA, 1701 nt, Artificial Sequence
  derived and/or modified sequence opt1 from hemagglutinin__InfluenzaA__AFJ78144
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcauccgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcccaggcguccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacaccaagguggaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 69887 - RNA, 1701 nt, Artificial Sequence; identical to SEQ ID NO: 69886
  derived and/or modified sequence opt1 from hemagglutinin__InfluenzaA__AFJ78155

SEQ ID NO: 69888 - RNA, 1701 nt, Artificial Sequence
  derived and/or modified sequence opt1 from hemagglutinin__InfluenzaA__AFJ78166
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagcggcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 69889 - RNA, 1701 nt, Artificial Sequence; identical to SEQ ID NO: 62737
  derived and/or modified sequence opt1 from hemagglutinin__InfluenzaA__AFJ78177

SEQ ID NO: 69890 - RNA, 1701 nt, Artificial Sequence
  derived and/or modified sequence opt1 from hemagglutinin__InfluenzaA__AFJ78188
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69891 - RNA, 1701 nt, Artificial Sequence
  derived and/or modified sequence opt1 from hemagglutinin__InfluenzaA__AFJ78210
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggaucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69892 - RNA, 1701 nt, Artificial Sequence; identical to SEQ ID NO: 69816
  derived and/or modified sequence opt1 from hemagglutinin__InfluenzaA__AFJ78221

SEQ ID NO: 69893 - RNA, 1701 nt, Artificial Sequence
  derived and/or modified sequence opt1 from hemagglutinin__InfluenzaA__AFJ78232
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggaagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcugaaccggcucaucggcaagaccaacgagaaguuccaccagaucgagaacgaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 69894 - RNA, 1701 nt, Artificial Sequence
  derived and/or modified sequence opt1 from hemagglutinin__InfluenzaA__AFJ78243
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgaaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccgugggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccacaagaacagcgaggggaccggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 69895 - RNA, 1701 nt, Artificial Sequence
  derived and/or modified sequence opt1 from hemagglutinin__InfluenzaA__AFJ78254
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagguggaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 69896 - RNA, 1701 nt, Artificial Sequence; identical to SEQ ID NO: 69895
  derived and/or modified sequence opt1 from hemagglutinin__InfluenzaA__AFJ78265

SEQ ID NO: 69897 - RNA, 1701 nt, Artificial Sequence
  derived and/or modified sequence opt1 from hemagglutinin__InfluenzaA__AFJ78276
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagguggaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 69898 - RNA, 1701 nt, Artificial Sequence
  derived and/or modified sequence opt1 from hemagglutinin__InfluenzaA__AFJ78287
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugauggacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucaccguguccacgaagcgcagccagcagaccgugauccccaacaucggcagccggccccgcguccggaacauccccucccgcaucagcaucuacuggaccaucgugaagccgggcgacauccugcugaucaacuccaccgggaaccucaucgcgccccggggcuacuucaagauccgcagcgggaaguccagcaucaugcgguccgacgcccccaucggcaagugcaacagcgagugcaucacgcccaacggcuccaucccgaacgacaagcccuuccagaacgugaaccgcaucaccuacggggccugcccccgguacgucaagcagaacacccugaagcuggccaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 69899 - RNA, 1698 nt, Artificial Sequence
  derived and/or modified sequence opt1 from hemagglutinin__InfluenzaA__AFJ78309
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggaccagcgggccaucuaccacacggagaacgccuacguguccgucgugagcucccacuacagccgccgguucaccccggagaucgccaagcgccccaaggugcgggaccaggagggccgcaucaacuacuacuggacccugcuggagcccggcgacaccaucaucuucgaggcgaacgggaaccucaucgcccccugguacgccuucgcccugucccggggcuucgggagcggcaucaucacguccaacgccccgauggacgagugcgacgcgaagugccagacgccccagggcgccaucaacagcucccugcccuuccagaacguccaccccaucaccaucggggagugcccgaaguacgugcgcagcgccaagcuccggauggugaccggccugcgcaacauccccuccauccagagccgggggcuguucggcgccaucgccggguucaucgagggcggcuggaccgggaugaucgacggcugguacggguaccaccaccagaacgagcagggcuccggguacgcggccgaccagaaguccacccagaacgccaucaacggcaucaccaacaaggucaacagcgugaucgagaagaugaacacccaguucacggccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacagcaacgucaagaaccuguacgagaaggugaagucccagcucaagaacaacgcgaaggagaucggcaacgggugcuucgaguucuaccacaagugcaacaacgagugcauggagagcgugaagaacggcaccuacgacuaccccaaguacuccgaggagagcaagcugaaccgggagaagaucgacggggucaagcuggagagcaugggcguguaccagauccucgccaucuacuccacgguggccagcucccugguccugcucgugagccugggcgccaucuccuucuggaugugcagcaacgggucccugcagugccgcaucugcaucuga

SEQ ID NO: 69900 - RNA, 1701 nt, Artificial Sequence
  derived and/or modified sequence opt1 from hemagglutinin__InfluenzaA__AFJ78320
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 69901 - RNA, 1698 nt, Artificial Sequence
  derived and/or modified sequence opt1 from hemagglutinin__InfluenzaA__AFJ78331
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 69902 - RNA, 1698 nt, Artificial Sequence; identical to SEQ ID NO: 69901
  derived and/or modified sequence opt1 from hemagglutinin__InfluenzaA__AFJ78342

SEQ ID NO: 69903 - RNA, 1698 nt, Artificial Sequence; identical to SEQ ID NO: 69901
  derived and/or modified sequence opt1 from hemagglutinin__InfluenzaA__AFJ78353

SEQ ID NO: 69904 - RNA, 1698 nt, Artificial Sequence
  derived and/or modified sequence opt1 from hemagglutinin__InfluenzaA__AFJ78364
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggaccagcgggccaucuaccacacggagaacgccuacguguccgucgugagcucccacuacaaccgccgguucaccccggagaucgccaagcgccccaaggugcggaaccaggagggccgcaucaacuacuacuggacccugcuggagcccggcgacaccaucaucuucgaggcgaacgggaaccucaucgcccccugguacgccuucgcccugagccggggcuucggguccggcaucaucacgagcaacgccccgauggacgagugcgacgcgaagugccagacgccccagggcgccaucaacuccagccugcccuuccagaacguccaccccaucaccaucggggagugcccgaaguacgugcgcuccgccaagcuccggauggugaccggccugcgcaacauccccagcauccagucccgggggcuguucggcgccaucgccggguucaucgagggcggcuggaccgggaugaucgacggcugguacggguaccaccaccagaacgagcagggcagcggguacgcggccgaccagaaguccacccagaacgccaucaacggcaucaccaacaaggucaacagcgugaucgagaagaugaacacccaguucacggccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacuccaacgucaagaaccuguacgagaaggucaagagccagcucaagaacaacgcgaaggagaucggcaacgggugcuucgaguucuaccacaagugcaacaacgagugcauggaguccgugaagaacggcaccuacgacuaccccaaguacagcgaggaguccaagcugaaccgggagaagaucgacggggugaagcuggagagcaugggcguguaccagauccucgccaucuacagcacgguggccuccagccugguccugcucgugucccugggcgccaucagcuucuggaugugcuccaacgggagccugcagugccgcaucugcaucuga

SEQ ID NO: 69905 - RNA, 1698 nt, Artificial Sequence
  derived and/or modified sequence opt1 from hemagglutinin__InfluenzaA__AFJ78375
augaaggccaagcugcucgugcugcugugcaccuucaccgccacguacgcggacaccaucugcaucggcuaccacgccaacaacagcaccgacaccgucgacacggugcucgagaagaacgugaccgucacccacuccaucaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccagcgucuccagcuucgagcgguucgagaucuucccgaaggaguccagcuggcccaaccacaccgugaccgggguguccgccagcugcucccacaacggcaagagcuccuucuaccgcaaccugcuguggcucaccgagaagaacgggcuguaccccaaccugagcaaguccuacgucaacaacaaggagaaggaggugcucgugcuguggggcguccaccaccccagcaacaucggggaccagcgggccaucuaccacacggagaacgccuacgugagcguggucuccagccacuacucccgccgguucaccccggagaucgugaagcgccccaaggugcgggaccaggagggccgcaucaacuacuacuggacccugcucgagcccggcgacaccaucaucuucgaggccaacgggaaccugaucgcgcccugguacgccuucgcccugagccggggcuucggguccggcaucaucacgagcaacgccccgauggacgagugcgacgccaagugccagacgccccagggcgcgaucaacuccagccuccccuuccagaacguccaccccgugaccaucggggagugcccgaaguacgugcgcuccgccaagcugcggauggucaccggccugcgcaacauccccagcauccagucccggggccucuucggggccaucgccggguucaucgagggcggcuggaccgggaugaucgacggcugguacggguaccaccaccagaacgagcagggcagcggguacgccgcggaccagaaguccacccagaacgccaucaacggcaucaccaacaaggugaacagcaucaucgagaagaugaacacccaguucacggccgugggcaaggaguucaacaagcuggagcgccggauggagaaccugaacaagaaggucgacgacggguuccucgacaucuggaccuacaacgccgagcugcuggugcuccuggagaacgagcgcacccuggacuuccacgacuccaacgucaagaaccucuacgagaaggucaagagccagcugaagaacaacgccaaggagaucggcaacgggugcuucgaguucuaccacaagugcaacaacgagugcauggaguccgugaagaacggcaccuacgacuaccccaaguacagcgaggaguccaagcugaaccgggagaagaucgacggggugaagcucgagagcaugggcguguaccagauccuggcgaucuacagcacgguggccuccagccugguccuccuggugucccugggcgccaucagcuucuggaugugcuccaacgggagccuccagugccgcaucugcaucuga

SEQ ID NO: 69906 - RNA, 1698 nt, Artificial Sequence; identical to SEQ ID NO: 62393
  derived and/or modified sequence opt1 from hemagglutinin__InfluenzaA__AFJ78386

SEQ ID NO: 69907 - RNA, 1698 nt, Artificial Sequence; identical to SEQ ID NO: 62393
  derived and/or modified sequence opt1 from hemagglutinin__InfluenzaA__AFJ78397

SEQ ID NO: 69908 - RNA, 1698 nt, Artificial Sequence; identical to SEQ ID NO: 69085
  derived and/or modified sequence opt1 from hemagglutinin__InfluenzaA__AFJ78408

SEQ ID NO: 69909 - RNA, 1698 nt, Artificial Sequence
  derived and/or modified sequence opt1 from hemagglutinin__InfluenzaA__AFJ78419
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggcuacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgcgcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccgucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 69910 - RNA, 1698 nt, Artificial Sequence
  derived and/or modified sequence opt1 from hemagglutinin__InfluenzaA__AFJ78430
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaaccccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugagcgucgugagcucccacuacagccgcaaguucacgcccgagaucgccaagcggcccaaggugcgcgaccaggagggccggaucaacuacuacuggacccuccuggggcccggcgacaccaucaucuucgaggcgaacgggaaccugaucgccccgcgcuacgccuucgcccucucccggggcuucggcagcgggaucaucaacuccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgggagaagaucgacggcgugaagcucgaguccaugggggucuaccagauccuggccaucuacagcaccguggccagcucccuggugcuccuggucagccugggcgccaucuccuucuggaugugcagcaacgggucccuccagugccgcaucugcaucuga

SEQ ID NO: 69911 - RNA, 1698 nt, Artificial Sequence
  derived and/or modified sequence opt1 from hemagglutinin__InfluenzaA__AFJ78441
augaaggugaagcugaugguccuccugugcaccuucaccgccacguacgccgacaccaucugcaucggcuaccacgcgaacaacagcaccgacaccguggacacggugcuggagaagaacgucaccgugacccacuccgugaaccuccuggaggacagccacaacgggaagcugugccuccugaagggcaucgcgccccugcagcucgggaacugcuccgucgccggcuggauccuggggaacccggagugcgagcugcucaucagccgcgaguccuggagcuacaucguggagaagcccaaccccgagaacgggaccugcuaccccggccacuucgccgacuacgaggagcugcgggagcagcuguccagcguguccagcuucgagcgcuucgagaucuucccgaaggaguccagcuggcccaaccacacggucaccgggguguccgccagcugcucccacaacggcaagagcuccuucuacaagaaccuccuguggcugaccgggaagaacggccucuaccccaaccugagcaaguccuacgccaacaacaaggagaaggaggugcugguccucuggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugucccgcggguucggcagcggcaucaucaacuccaacgcccccauggacgagugcgacgcgaagugccagacgccccagggggccaucaacagcucccuccccuuccagaacguccacccggugaccaucggcgagugccccaaguacgugcggagcgccaagcugcgcauggucaccgggcugcggaacauccccuccauccagagccgcggccucuucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggacaaggaguucaacaagcuggagcggcgcauggagaaccugaacaagaaggucgacgacggguucaucgacaucuggaccuacaacgccgagcuccuggugcugcucgagaacgagcggacgcuggacuuccacgacagcaacgugaagaaccuguacgagaaggucaagucccagcucaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcuggaguccaugggcgucuaccagauccucgccaucuacagcaccguggccagcucccuggugcugcucgucagccugggcgccaucuccuucuggaugugcagcaacgggucccugcagugccggaucugcaucuga

SEQ ID NO: 69912 - RNA, 1698 nt, Artificial Sequence
  derived and/or modified sequence opt1 from hemagglutinin__InfluenzaA__AFJ78452
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucauccccgagaucgccaagcggcccaaggugcgcgaccaggagggccggaucaacuacuacuggacgcuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggacguacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69913 - RNA, 1698 nt, Artificial Sequence
  derived and/or modified sequence opt1 from hemagglutinin__InfluenzaA__AFJ78463
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugggcaagagcuacgccaacaacaaggagaaggaggugcucguccuguggggcgugcaccacccgcccaacaucggcgaccagaaggcccuguaccacaccgagaacgccuacguguccgucgugagcagccacuacucccgcaaguucauccccgagaucgccaagcggcccaaggugcgcgaccaggaggggcggaucaacuacuacuggacgcuccuggagcccggcgacaccaucaucuucgaggcgaacgggaaccugaucgccccgcgcuacgccuucgcccucagccggggcuucggcuccgggaucaucaacagcaacgcccccauggacgagugcgacgcgaagugccagacgccccagggcgccaucaacuccagccugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacgcaguucaccgccgugggcaaggaguucaacaagcuggagcgccggauggagaaccucaacaagaaggucgacgacggguucaucgacaucuggaccuacaacgccgagcugcuggugcuccuggagaacgagcgcacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcacguacgacuaccccaaguacagcgaggaguccaagcugaaccgggagaagaucgacggcgugaagcucgagagcaugggggucuaccagauccuggccaucuacuccaccguggccagcagccuggugcuccuggucucccugggcgccaucagcuucuggaugugcuccaacgggagccuccagugccgcaucugcaucuga

SEQ ID NO: 69914 - RNA, 1698 nt, Artificial Sequence
  derived and/or modified sequence opt1 from hemagglutinin__InfluenzaA__AFJ78474
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcuccuacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69915 - RNA, 1698 nt, Artificial Sequence
  derived and/or modified sequence opt1 from hemagglutinin__InfluenzaA__AFJ78485
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggaggacggcuucaucgacaucuggacguacaacgccgagcugcugguccuccuggagaacgagcgcacccuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacagcaccgucgccagcucccuggugcuccuggugagccugggggccaucuccuucuggaugugcagcaacggcucccuccagugccgcaucugcaucuga

SEQ ID NO: 69916 - RNA, 1698 nt, Artificial Sequence
  derived and/or modified sequence opt1 from hemagglutinin__InfluenzaA__AFJ78496
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcggccagcgggcccuguaccacacggagaacgccuacgugagcguggucagcucccacuacagccgcaaguucacccccgagaucgccaagcggcccaaggugcgcgaccaggaggggcggaucaacuacuacuggacccuccuggagcccggcgacaccaucaucuucgaggcgaacgggaaccugaucgccccgcgcuacgccuucgcccucucccggggcuucggcagcgggaucaucaacuccaacgcccccauggacgagugcgacgcgaagugccagacgccccagggcgccaucaacagcucccugcccuuccagaacgugcacccggucaccaucggggagugccccaaguacgugcgcagcgccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacagcaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacagcaccgucgccagcucccuggugcuccuggugagccugggcgccaucuccuucuggaugugcagcaacgggucccuccagugccgcaucugcaucuga

SEQ ID NO: 69917 - RNA, 1698 nt, Artificial Sequence
  derived and/or modified sequence opt1 from hemagglutinin__InfluenzaA__AFJ78518
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacgcagaacgccaucaacggcaucaccaacaaggugaacagcgugaucgagaagaugaacacccaguucaccgccgucgggaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgggagaagaucgacggcgugaagcucgaguccaugggcguguaccagauccuggccaucuacagcaccgucgccagcucccuggugcuccuggugagccugggggccaucuccuucuggaugugcagcaacggcucccuccagugccgcaucugcaucuga

SEQ ID NO: 69918 - RNA, 1698 nt, Artificial Sequence
  derived and/or modified sequence opt1 from hemagglutinin__InfluenzaA__AFJ78529
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcucgagagcaugggcguguaccagauccuggcgaucuacuccaccguggccagcagccugguccuccuggugucccugggggccaucagcuucuggaugugcuccaacggcagccuccagugccggaucugcaucuga

SEQ ID NO: 69919 - RNA, 1698 nt, Artificial Sequence; identical to SEQ ID NO: 69918
  derived and/or modified sequence opt1 from hemagglutinin__InfluenzaA__AFJ78540

SEQ ID NO: 69920 - RNA, 1698 nt, Artificial Sequence; identical to SEQ ID NO: 69918
  derived and/or modified sequence opt1 from hemagglutinin__InfluenzaA__AFJ78551

SEQ ID NO: 69921 - RNA, 1698 nt, Artificial Sequence
  derived and/or modified sequence opt1 from hemagglutinin__InfluenzaA__AFJ78562
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccacccuguccaagagcuacgccaacaacaaggagaaggaggugcucguccuguggggcgugcaccacccgcccaacaucggcgaccagaugacgcuguaccacaaggagaacgccuacguguccgucgugagcagccacuacucccggaaguucacccccgagaucgccaagcgccucaaggugcgggaccaggagggccgcaucaacuacuacuggacccugcuggagcccggggacaccaucaucuucgaggccaacggcaaccucaucgcgccccgguacgccuucgcccugagccgcgggcugggcuccggcaucaucaacagcaacgccccgauggacgagugcgacgccaagugccagacgccccagggggcgaucaacuccagccuccccuuccagaacguccaccccgugaccaucggcgagugcccgaaguacgugcgguccgccaagcugcgcauggucaccgggcugcggaacauccccagcauccagucccgcggccucuucggggccaucgccggcuucaucgagggcggguggaccggcaugguggacgggugguacggcuaccaccaccagaacgagcaggggagcggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccugaacaagaaggucgacgacggcuucaucgacguguggacguacaacgccgagcuccuggugcugcucgagaacgagcggacccuggacuuccacgacuccaacgucaagaaccuguacgagaaggugaagaaccagcucaagaacaacgccaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcuggagagcaugggcguguaccagauccucgcgaucuacuccaccguggccagcagccugguccugcucgugucccugggggccaucagcuucuggaugugcuccaacggcagccugcagugccggaucugcaucuga

SEQ ID NO: 69922 - RNA, 1698 nt, Artificial Sequence
  derived and/or modified sequence opt1 from hemagglutinin__InfluenzaA__AFJ78573
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgccuccauggacgagugcgacgccaagugccagacgccccagggggcgaucaacagcucccugcccuuccagaacguccaccccgugaccaucggcgagugcccgaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaggcgaagcugucccgcgagaagaucgacggcgucaagcucgagagcaugggcguguaccagauccuggccaucuacuccaccguggccagcagccugguccuccuggugucccugggggccaucagcuucuggaugugcuccaacggcagccuccagugccggaucugcaucuga

SEQ ID NO: 69923 - RNA, 1698 nt, Artificial Sequence
  derived and/or modified sequence opt1 from hemagglutinin__InfluenzaA__AFJ78584
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccagcugcucccacaacggcgagaacagcuucuaccgcaaccugcuguggcucacccggaagaacgggcuguaccccaaccuguccaagagcuacgccaacaacaaggagaaggaggugcucguccuguggggcgugcaccacccgcccaacaucggggaccagaaggcccuguaccacaccgagaacgccuacguguccgucgugagcagccacuacucccgcaaguucacgcccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucagccggggcuucggguccggcaucaucaacagcaacgcccccauggacaagugcgacgcgaagugccagacgccccagggcgccaucaacuccagccugcccuuccagaacguccacccgguggccaucggggagugccccaaguacgugcgcuccgccaagcugcggauggucaccggccuccgcaacauccccagcauccagucccgggggcuguucggcgccaucgcgggguucaucgagggcggcuggaccgggaugguggacggcugguacggguaccaccaccagaacgagcagggcagcggguacgccgccgaccagaaguccacccagaacgccaucaacggcaucaccaacaaggugaacagcgucaucgagaagaugaacacgcaguucaccgccgugggcaaggaguucaacaagcuggagcgccggauggagaaccucaacaagaaggucgacgacggguucaucgacaucuggaccuacaacgcggagcugcuggugcuccuggagaacgagcgcacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcugaaccgggagaagaucgacggggugaagcucgagagcaugggcgucuaccagauccuggccaucuacuccaccguggccagcagccuggugcuccuggucucccugggcgccaucagcuucuggaugugcuccaacgggagccuccagugccgcaucugcaucuga

SEQ ID NO: 69924 - RNA, 1698 nt, Artificial Sequence
  derived and/or modified sequence opt1 from hemagglutinin__InfluenzaA__AFJ78595
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaaccgggagaaggaggugcucguccuguggggcgugcaccacccgcccaacaucggcgaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 69925 - RNA, 1698 nt, Artificial Sequence
  derived and/or modified sequence opt1 from hemagglutinin__InfluenzaA__AFJ78617
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacgacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggagaacgcccacguguccgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugagcaaggaguucaacaagcuggagcggcgcauggagaaccucaacaagaaggucgacgacggcuucaucgacaucuggacguacaacgccgagcugcuggugcuccuggagaacgagcggacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggagagcaagcugaaccgcgagaagaucgacggcgugaagcucgaguccaugggggucuaccagauccuggcgaucuacagcaccguggccuccagccuggugcuccuggucucccugggcgccaucagcuucuggaugugcuccaacggcagccuccagugccggaucugcaucuga

SEQ ID NO: 69926 - RNA, 1698 nt, Artificial Sequence
  derived and/or modified sequence opt1 from hemagglutinin__InfluenzaA__AFJ78628
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagcgccccaaccccgagaacgggaccugcuaccccggccacuucgccgacuacgaggagcugcgggagcagcucagcuccgugagcuccuucgagcgcuucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccggaaguucacgcccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcucgagagcaugggcguguaccagauccuggcgaucuacuccaccguggccagcagccugguccuccuggugucccugggggccaucagcuucuggaugugcuccaacggcagccuccagugccggaucugcaucuga

SEQ ID NO: 69927 - RNA, 1698 nt, Artificial Sequence
  derived and/or modified sequence opt1 from hemagglutinin__InfluenzaA__AFJ78639
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcaaccagaagacccuguaccacacggagaacgccuacguguccgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgagagcaugggcgucuaccagauccuggcgaucuacuccaccguggccagcucccuggugcuccuggucagccugggcgccaucuccuucuggaugugcagcaacgggucccuccagugccggaucugcaucuga

SEQ ID NO: 69928 - RNA, 1698 nt, Artificial Sequence; identical to SEQ ID NO: 69927
  derived and/or modified sequence opt1 from hemagglutinin__InfluenzaA__AFJ78650

SEQ ID NO: 69929 - RNA, 1701 nt, Artificial Sequence; identical to SEQ ID NO: 63677
  derived and/or modified sequence opt1 from hemagglutinin__InfluenzaA__AFJ78661

SEQ ID NO: 69930 - RNA, 1701 nt, Artificial Sequence
  derived and/or modified sequence opt1 from hemagglutinin__InfluenzaA__AFJ78681
augaaggccauccuggugguccuccuguacaccuucgccaccgugaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 69931 - RNA, 1701 nt, Artificial Sequence; identical to SEQ ID NO: 63677
  derived and/or modified sequence opt1 from hemagglutinin__InfluenzaA__AFJ78691

SEQ ID NO: 69932 - RNA, 1701 nt, Artificial Sequence; identical to SEQ ID NO: 63677
  derived and/or modified sequence opt1 from hemagglutinin__InfluenzaA__AFJ78701

SEQ ID NO: 69933 - RNA, 1701 nt, Artificial Sequence; identical to SEQ ID NO: 68205
  derived and/or modified sequence opt1 from hemagglutinin__InfluenzaA__AFJ78711

SEQ ID NO: 69934 - RNA, 1701 nt, Artificial Sequence; identical to SEQ ID NO: 63677
  derived and/or modified sequence opt1 from hemagglutinin__InfluenzaA__AFJ78721

SEQ ID NO: 69935 - RNA, 1701 nt, Artificial Sequence
  derived and/or modified sequence opt1 from hemagglutinin__InfluenzaA__AFJ78731
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcuccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 69936 - RNA, 1701 nt, Artificial Sequence; identical to SEQ ID NO: 64841
  derived and/or modified sequence opt1 from hemagglutinin__InfluenzaA__AFJ78741

SEQ ID NO: 69937 - RNA, 1701 nt, Artificial Sequence; identical to SEQ ID NO: 63677
  derived and/or modified sequence opt1 from hemagglutinin__InfluenzaA__AFJ78751

SEQ ID NO: 69938 - RNA, 1701 nt, Artificial Sequence; identical to SEQ ID NO: 63677
  derived and/or modified sequence opt1 from hemagglutinin__InfluenzaA__AFJ78761

SEQ ID NO: 69939 - RNA, 1701 nt, Artificial Sequence; identical to SEQ ID NO: 63677
  derived and/or modified sequence opt1 from hemagglutinin__InfluenzaA__AFJ78771

SEQ ID NO: 69940 - RNA, 1701 nt, Artificial Sequence; identical to SEQ ID NO: 63677
  derived and/or modified sequence opt1 from hemagglutinin__InfluenzaA__AFJ78781

SEQ ID NO: 69941 - RNA, 1701 nt, Artificial Sequence; identical to SEQ ID NO: 63677
  derived and/or modified sequence opt1 from hemagglutinin__InfluenzaA__AFJ78791

SEQ ID NO: 69942 - RNA, 1701 nt, Artificial Sequence; identical to SEQ ID NO: 63677
  derived and/or modified sequence opt1 from hemagglutinin__InfluenzaA__AFJ78801

SEQ ID NO: 69943 - RNA, 1701 nt, Artificial Sequence; identical to SEQ ID NO: 64538
  derived and/or modified sequence opt1 from hemagglutinin__InfluenzaA__AFJ78811

SEQ ID NO: 69944 - RNA, 1701 nt, Artificial Sequence; identical to SEQ ID NO: 63677
  derived and/or modified sequence opt1 from hemagglutinin__InfluenzaA__AFJ78821

SEQ ID NO: 69945 - RNA, 1701 nt, Artificial Sequence; identical to SEQ ID NO: 63677
  derived and/or modified sequence opt1 from hemagglutinin__InfluenzaA__AFJ78831

SEQ ID NO: 69946 - RNA, 1701 nt, Artificial Sequence; identical to SEQ ID NO: 64875
  derived and/or modified sequence opt1 from hemagglutinin__InfluenzaA__AFJ78841

SEQ ID NO: 69947 - RNA, 1701 nt, Artificial Sequence; identical to SEQ ID NO: 63677
  derived and/or modified sequence opt1 from hemagglutinin__InfluenzaA__AFJ78851

SEQ ID NO: 69948 - RNA, 1701 nt, Artificial Sequence
  derived and/or modified sequence opt1 from hemagglutinin__InfluenzaA__AFJ78861
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 69949 - RNA, 1701 nt, Artificial Sequence
  derived and/or modified sequence opt1 from hemagglutinin__InfluenzaA__AFJ78881
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccagcuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucaacggcgugaagcucgaguccacccgcaucuaccagauccuggccaucuacagcaccgcggccagcucccugguccucguggugagccugggggccaucuccuucuggaugugcagcaacggcucccugcagugccggaucugcaucuga

SEQ ID NO: 69950 - RNA, 1701 nt, Artificial Sequence; identical to SEQ ID NO: 63677
  derived and/or modified sequence opt1 from hemagglutinin__InfluenzaA__AFJ78891

SEQ ID NO: 69951 - RNA, 1701 nt, Artificial Sequence; identical to SEQ ID NO: 63677
  derived and/or modified sequence opt1 from hemagglutinin__InfluenzaA__AFJ78901

SEQ ID NO: 69952 - RNA, 1701 nt, Artificial Sequence; identical to SEQ ID NO: 63677
  derived and/or modified sequence opt1 from hemagglutinin__InfluenzaA__AFJ78911

SEQ ID NO: 69953 - RNA, 1701 nt, Artificial Sequence; identical to SEQ ID NO: 63677
  derived and/or modified sequence opt1 from hemagglutinin__InfluenzaA__AFJ78921

SEQ ID NO: 69954 - RNA, 1701 nt, Artificial Sequence
  derived and/or modified sequence opt1 from hemagglutinin__InfluenzaA__AFJ97567
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcacggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucaccauggagcgcaacgccgggagcggcaucaucaucuccgacacccccgugcacgacugcaacaccacgugccagaccccgaagggcgccaucaacaccagcuuccccuuccagaacauccaccccaucaccaucgggaagugccccaaguacgugaaguccacgaagcugcggcuggccaccggccuccgcaacgucccgagcauccagucccgggggcuguucggcgccaucgcgggguucaucgagggcggcuggaccgggaugguggacggcugguacggguaccaccaccagaacgagcagggcagcggguacgccgccgaccugaaguccacccagaacgccaucgacgagaucacgaacaaggugaacagcgucaucgagaagaugaacacccaguucaccgccgugggcaaggaguucaaccaccucgagaagcgcaucgagaaccugaacaagaaggucgacgacggcuuccuggacaucuggaccuacaacgcggagcuccuggugcugcucgagaacgagcggacgcuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgccuccagccuggugcugguggucagccucggggcgaucuccuucuggaugugcagcaacggcucccugcagugccggaucugcaucuga

SEQ ID NO: 69955 - RNA, 1701 nt, Artificial Sequence; identical to SEQ ID NO: 63677
  derived and/or modified sequence opt1 from hemagglutinin__InfluenzaA__AFK14115

SEQ ID NO: 69956 - RNA, 1701 nt, Artificial Sequence; identical to SEQ ID NO: 63677
  derived and/or modified sequence opt1 from hemagglutinin__InfluenzaA__AFK14131

SEQ ID NO: 69957 - RNA, 1701 nt, Artificial Sequence; identical to SEQ ID NO: 65359
  derived and/or modified sequence opt1 from hemagglutinin__InfluenzaA__AFK14139

SEQ ID NO: 69958 - RNA, 1701 nt, Artificial Sequence
  derived and/or modified sequence opt1 from hemagglutinin__InfluenzaA__AFK14148
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 69959 - RNA, 1701 nt, Artificial Sequence; identical to SEQ ID NO: 65304
  derived and/or modified sequence opt1 from hemagglutinin__InfluenzaA__AFK14157

SEQ ID NO: 69960 - RNA, 1701 nt, Artificial Sequence; identical to SEQ ID NO: 63677
  derived and/or modified sequence opt1 from hemagglutinin__InfluenzaA__AFK14166

SEQ ID NO: 69961 - RNA, 1701 nt, Artificial Sequence; identical to SEQ ID NO: 65005
  derived and/or modified sequence opt1 from hemagglutinin__InfluenzaA__AFK14175

SEQ ID NO: 69962 - RNA, 1701 nt, Artificial Sequence; identical to SEQ ID NO: 66582
  derived and/or modified sequence opt1 from hemagglutinin__InfluenzaA__AFK14184

SEQ ID NO: 69963 - RNA, 1701 nt, Artificial Sequence; identical to SEQ ID NO: 64030
  derived and/or modified sequence opt1 from hemagglutinin__InfluenzaA__AFK14193

SEQ ID NO: 69964 - RNA, 1701 nt, Artificial Sequence; identical to SEQ ID NO: 65274
  derived and/or modified sequence opt1 from hemagglutinin__InfluenzaA__AFK14202

SEQ ID NO: 69965 - RNA, 1701 nt, Artificial Sequence; identical to SEQ ID NO: 64030
  derived and/or modified sequence opt1 from hemagglutinin__InfluenzaA__AFK14211

SEQ ID NO: 69966 - RNA, 1701 nt, Artificial Sequence
  derived and/or modified sequence opt1 from hemagglutinin__InfluenzaA__AFK14220
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgccagcuccuucgagcgcuacgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacagcaccguggccuccagccugguccucguggugagccugggggccaucuccuucuggaugugcagcaacggcucccugcagugccggaucugcaucuga

SEQ ID NO: 69967 - RNA, 1701 nt, Artificial Sequence; identical to SEQ ID NO: 65304
  derived and/or modified sequence opt1 from hemagglutinin__InfluenzaA__AFK14229

SEQ ID NO: 69968 - RNA, 1701 nt, Artificial Sequence; identical to SEQ ID NO: 68442
  derived and/or modified sequence opt1 from hemagglutinin__InfluenzaA__AFK14238

SEQ ID NO: 69969 - RNA, 1701 nt, Artificial Sequence
  derived and/or modified sequence opt1 from hemagglutinin__InfluenzaA__AFK14247
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaugaacaccucccugcccuuccagaacauccaccccaucaccaucgggaagugccccaaguacgucaagagcaccaagcugcggauggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 69970 - RNA, 1701 nt, Artificial Sequence
  derived and/or modified sequence opt1 from hemagglutinin__InfluenzaA__AFK14272
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugaccggcguggcgccccugcaccucgggaagugcgacaucgccggcuggauccuggggaacccggagugcgagagccuguccaccgccagcuccuggagcuacaucgucgagacguccagcuccgacaacgggaccugcuaccccggcgacuucaucgacuacgaggagcuccgcgagcagcugagcuccgugagcuccuucgagcgguucgagaucuuccccaagaccagcuccuggcccaaccacgacagcaacaagggcgugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcacguccgccgaccagcagagccuguaccagaacgccgacgccuacgucuucgugggcaccucccgcuacagcaagaaguucaagcccgagaucgccauccggccgaaggugcgcgaccaggagggccggaugaacuacuacuggacccuggucgagcccggggacaagaucaccuucgaggcgacgggcaaccucguggugccccgcuacgccuucgccauggagcggaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagcacgcgaucgacgagaucaccaacaaggugaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 69971 - RNA, 1701 nt, Artificial Sequence; identical to SEQ ID NO: 64030
  derived and/or modified sequence opt1 from hemagglutinin__InfluenzaA__AFK14314

SEQ ID NO: 69972 - RNA, 1701 nt, Artificial Sequence
  derived and/or modified sequence opt1 from hemagglutinin__InfluenzaA__AFK14323
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 69973 - RNA, 1701 nt, Artificial Sequence; identical to SEQ ID NO: 68442
  derived and/or modified sequence opt1 from hemagglutinin__InfluenzaA__AFK14332

SEQ ID NO: 69974 - RNA, 1701 nt, Artificial Sequence
  derived and/or modified sequence opt1 from hemagglutinin__InfluenzaA__AFK14341
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagaagacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 69975 - RNA, 1701 nt, Artificial Sequence; identical to SEQ ID NO: 65097
  derived and/or modified sequence opt1 from hemagglutinin__InfluenzaA__AFK14350

SEQ ID NO: 69976 - RNA, 1701 nt, Artificial Sequence
  derived and/or modified sequence opt1 from hemagglutinin__InfluenzaA__AFK14358
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcgccugcuaccccggcgacuucaucgacuacgaggagcuccgggagcagcugagcuccgugagcuccuucgagcgcuucgagaucuuccccaagacgagcuccuggcccaaccacgacagcaacaagggggucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggagcaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagaagacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgcgaggagaucgacggcgugaagcucgagagcacccggaucuaccagauccuggccaucuacuccaccgucgccagcagccuggugcucguggucucccugggggccaucagcuucuggaugugcuccaacggcagccugcagugccgcaucugcaucuga

SEQ ID NO: 69977 - RNA, 1701 nt, Artificial Sequence
  derived and/or modified sequence opt1 from hemagglutinin__InfluenzaA__AFK14395
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgagaacggcaugugcugcccccgggacuucaucgacuacgaggagcugcgcgagcagcucagcuccgugagcuccuucgagcgguucgagaucuuccccaagacgagcuccuggcccaaccacgacagcaacaagggcgucaccgccgccugcccgcacgccggggcgaaguccuucuacaagaaccugaucuggcuggugaagaagggcaacagcuaccccaagcucuccaagagcuacaucaacgacaaggggaaggaggugcugguccuguggggcauccaccaccccagcaccuccgccgaccagcagagccucuaccagaacgccgacgccuacguguucgugggguccagccgcuacuccaagaaguucaagcccgagaucgccauccggccgaagguccgcgaccaggagggccggaugaacuacuacuggacccugguggagcccggcgacaagaucacguucgaggcgaccgggaaccugguggucccccgcuacgccuucgccauggagcggaacgccggcagcgggaucaucaucuccgacacccccgugcacgacugcaacaccacgugccagaccccgaagggcgccaucaacaccagccuccccuuccagaacauccaccccaucaccaucggcaagugccccaaguacgugaaguccacgaagcugcgccuggcgaccgggcuccggaacgucccgagcauccagucccgcggccuguucggggccaucgccggcuucaucgagggcggguggaccggcaugguggacgggugguacggcuaccaccaccagaacgagcaggggagcggcuacgccgccgaccugaaguccacccagaacgcgaucgacgagaucacgaacaaggugaacagcgucaucgagaagaugaacacccaguucaccgccguggggaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggagccagcucaagaacaacgccaaggaggugggcaacgggugcuucgaguucuaccacaagugcgacaacacgugcauggaguccgugaagaacggcaccuacgacuaccccaaguacagcgaggaggccaagcugaaccgcgaggagaucgacggggucaagcuggaguccacccggaucuaccagauccucgcgaucuacagcaccgccgccagcucccuggugcugguggucagccucggcgccaucuccuucuggaugugcagcaacgggucccugcagugccgcaucugcaucuga

SEQ ID NO: 69978 - RNA, 1701 nt, Artificial Sequence
  derived and/or modified sequence opt1 from hemagglutinin__InfluenzaA__AFK14431
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaacagcgacaacggcacgugcuaccccggcgacuuccucgacuacgaggagcugcggaagcagcuguccagcguguccagcuucgagcgcgucgagaucuuccccaagaccuccagcuggcccaaccacgacuccaacaagggggugaccgccgccugcccgcacgccggcgccaagagcuucuacaagaaccucaucuggcuggugaagaaggggaacuccuaccccaagcugagcaaguccuacaucaacgacaagggcaaggagguccucgugcugugggggauccaccaccccagcaccagcgccgaccagcagucccuguaccagaacgccgacgccuacguguucgucggcacgagccgguacuccaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcuccggcuggcgaccggccugcgcaacgugccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggucaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacagcaccguggccuccagccucgugcuggucgugagccugggggccaucuccuucuggaugugcagcaacggcucccuccagugccggaucugcaucuga

SEQ ID NO: 69979 - RNA, 1701 nt, Artificial Sequence; identical to SEQ ID NO: 63677
  derived and/or modified sequence opt1 from hemagglutinin__InfluenzaA__AFK14456

SEQ ID NO: 69980 - RNA, 1701 nt, Artificial Sequence; identical to SEQ ID NO: 63677
  derived and/or modified sequence opt1 from hemagglutinin__InfluenzaA__AFK14465

SEQ ID NO: 69981 - RNA, 1701 nt, Artificial Sequence
  derived and/or modified sequence opt1 from hemagglutinin__InfluenzaA__AFK14536
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuacuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 69982 - RNA, 1701 nt, Artificial Sequence; identical to SEQ ID NO: 63677
  derived and/or modified sequence opt1 from hemagglutinin__InfluenzaA__AFK14571

SEQ ID NO: 69983 - RNA, 1701 nt, Artificial Sequence; identical to SEQ ID NO: 68186
  derived and/or modified sequence opt1 from hemagglutinin__InfluenzaA__AFK14586

SEQ ID NO: 69984 - RNA, 1701 nt, Artificial Sequence
  derived and/or modified sequence opt1 from hemagglutinin__InfluenzaA__AFK14595
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccgaagugcgagagccuguccaccgccagcuccuggagcuacaucggcgagaccuccagcuccaacaacggcacgugcuaccccgggaacuucaucgacuucgaggagcucaagaagcagcugagcuccgugagcuccuucgagcgcuucgagaucuuccccaagaccagcuccuggcccaaccacgacagcaacaagggcgugaccgccgccugcccgcacgccggggcgaaguccuucuacaagaaccugaucuggcucgucaagaagggcaacagcuaccccaagcuguccaagagcuacaucaacgacaaggggaaggaggugcuggugcucuggggcauccaccaccccagcaccuccgccgaccagcagagccuguaccagaacgccgacgccuacgucuucgugggcacgucccgguacagcaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcaacgccggcuccggcaucaucaucagcgacacgcccguccacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 69985 - RNA, 1701 nt, Artificial Sequence; identical to SEQ ID NO: 68186
  derived and/or modified sequence opt1 from hemagglutinin__InfluenzaA__AFK14612

SEQ ID NO: 69986 - RNA, 1701 nt, Artificial Sequence; identical to SEQ ID NO: 63677
  derived and/or modified sequence opt1 from hemagglutinin__InfluenzaA__AFK14621

SEQ ID NO: 69987 - RNA, 1701 nt, Artificial Sequence
  derived and/or modified sequence opt1 from hemagglutinin__InfluenzaA__AFK14630
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacccgggccgaccugcaguccaucaaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 69988 - RNA, 1701 nt, Artificial Sequence
  derived and/or modified sequence opt1 from hemagglutinin__InfluenzaA__AFK14639
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcgggcagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgcgaucuacuccaccgucgccagcagccuggugcugguggucucccucggcgccaucagcuucuggaugugcuccaacggcagccugcagugccggaucugcaucuga

SEQ ID NO: 69989 - RNA, 1701 nt, Artificial Sequence; identical to SEQ ID NO: 63677
  derived and/or modified sequence opt1 from hemagglutinin__InfluenzaA__AFK14661

SEQ ID NO: 69990 - RNA, 1701 nt, Artificial Sequence; identical to SEQ ID NO: 68186
  derived and/or modified sequence opt1 from hemagglutinin__InfluenzaA__AFK14670

SEQ ID NO: 69991 - RNA, 1701 nt, Artificial Sequence; identical to SEQ ID NO: 68186
  derived and/or modified sequence opt1 from hemagglutinin__InfluenzaA__AFK14678

SEQ ID NO: 69992 - RNA, 1701 nt, Artificial Sequence
  derived and/or modified sequence opt1 from hemagglutinin__InfluenzaA__AFK14688
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucauccacgacgaggagcuccggaagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaaggccggguccggcaucaucauccuggacacgcccgugcacgacuggaacacgaccugcgagaccccgaagggcgccgugaacaccagccugcccuuccagaacauccaccccaucaccaucgggaagugccccaaguacgucaaguccaccaagcuccggcuggcgaccggccugcgcaacgugccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggucaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacagcaccguggccuccagccucgugcuggucgugagccugggggccaucuccuucuggaugugcagcaacggcucccuccagugccggaucugcaucuga

SEQ ID NO: 69993 - RNA, 1701 nt, Artificial Sequence; identical to SEQ ID NO: 68186
  derived and/or modified sequence opt1 from hemagglutinin__InfluenzaA__AFK14697

SEQ ID NO: 69994 - RNA, 1701 nt, Artificial Sequence; identical to SEQ ID NO: 68186
  derived and/or modified sequence opt1 from hemagglutinin__InfluenzaA__AFK14713

SEQ ID NO: 69995 - RNA, 1701 nt, Artificial Sequence; identical to SEQ ID NO: 68186
  derived and/or modified sequence opt1 from hemagglutinin__InfluenzaA__AFK14722

SEQ ID NO: 69996 - RNA, 1701 nt, Artificial Sequence
  derived and/or modified sequence opt1 from hemagglutinin__InfluenzaA__AFK14731
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccggaagcagcugagcuccgugagcuccuucgagcgcgucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccgucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 69997 - RNA, 1701 nt, Artificial Sequence; identical to SEQ ID NO: 68186
  derived and/or modified sequence opt1 from hemagglutinin__InfluenzaA__AFK14740

SEQ ID NO: 69998 - RNA, 1701 nt, Artificial Sequence; identical to SEQ ID NO: 68186
  derived and/or modified sequence opt1 from hemagglutinin__InfluenzaA__AFK14749

SEQ ID NO: 69999 - RNA, 1701 nt, Artificial Sequence; identical to SEQ ID NO: 68186
  derived and/or modified sequence opt1 from hemagglutinin__InfluenzaA__AFK14756

SEQ ID NO: 70000 - RNA, 1701 nt, Artificial Sequence; identical to SEQ ID NO: 68186
  derived and/or modified sequence opt1 from hemagglutinin__InfluenzaA__AFK14764

SEQ ID NO: 70001 - RNA, 1701 nt, Artificial Sequence
  derived and/or modified sequence opt1 from hemagglutinin__InfluenzaA__AFK14779
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccagcuccuggagcuacaucguggagaccuccagcuccgacaacggcacgugcuaccccgggaacuucaucgacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgcuacagcaagaaguucaagcccgagaucgccauccggccgaagguccgcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 70002 - RNA, 1701 nt, Artificial Sequence
  derived and/or modified sequence opt1 from hemagglutinin__InfluenzaA__AFK14788
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcuccggaaguccuacaucaacgacaagggcaaggaggugcugguccugugggggauccaccaccccagcaccagcgccgaccagcagucccucuaccagaacgccgacgccuacguguucgugggcagcucccgcuacagcaagaaguucaagcccgagaucgccauccggccgaagguccgcgaccaggagggccggaugaacuacuacuggacgcugguggagcccggggacaagaucaccuucgaggcgaccggcaaccugguggucccccgcuacgccuucgccauggagcggaacgccggguccggcaucaucaucagcgacacccccgugcacgacugcaacacgaccugccagaccccgaagggcgccaucaacaccucccuccccuuccagaacauccaccccaucacgaucgggaagugccccaaguacgucaagagcaccaagcugcgccuggcgaccggccuccggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcggaucgagaaccugaacaagaaggucgacgacggcuuccuggacaucuggacguacaacgccgagcuccuggugcugcucgagaacgagcgcacccuggacuaccacgacagcaacgugaagaaccuguacgagaagguccggucccagcucaagaacaacgccaaggagguggggaacggcugcuucgaguucuaccacaagugcgacaacacgugcauggagagcgugaagaacgggaccuacgacuaccccaaguacuccgaggaggccaagcugaaccgcgaggagaucgacggcgucaagcuggagagcacccggaucuaccagauccucgcgaucuacuccaccgccgccagcagccuggugcugguggucucccucggggccaucagcuucuggaugugcuccaacggcagccugcagugccgcaucugcaucuga

SEQ ID NO: 70003 - RNA, 1701 nt, Artificial Sequence
  derived and/or modified sequence opt1 from hemagglutinin__InfluenzaA__AFK14798
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccggaagcagcugagcuccgugagcuccuucgagcgcgucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70004 - RNA, 1701 nt, Artificial Sequence
  derived and/or modified sequence opt1 from hemagglutinin__InfluenzaA__AFK14814
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuacgagcgcuacgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70005 - RNA, 1701 nt, Artificial Sequence
  derived and/or modified sequence opt1 from hemagglutinin__InfluenzaA__AFK14831
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucagcgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 70006 - RNA, 1701 nt, Artificial Sequence; identical to SEQ ID NO: 63677
  derived and/or modified sequence opt1 from hemagglutinin__InfluenzaA__AFK14839

SEQ ID NO: 70007 - RNA, 1701 nt, Artificial Sequence
  derived and/or modified sequence opt1 from hemagglutinin__InfluenzaA__AFK14847
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgccagcuccuucgagcgcuacgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 70008 - RNA, 1701 nt, Artificial Sequence; identical to SEQ ID NO: 68186
  derived and/or modified sequence opt1 from hemagglutinin__InfluenzaA__AFK14868

SEQ ID NO: 70009 - RNA, 1701 nt, Artificial Sequence; identical to SEQ ID NO: 64841
  derived and/or modified sequence opt1 from hemagglutinin__InfluenzaA__AFK14884

SEQ ID NO: 70010 - RNA, 1701 nt, Artificial Sequence; identical to SEQ ID NO: 64841
  derived and/or modified sequence opt1 from hemagglutinin__InfluenzaA__AFK14892

SEQ ID NO: 70011 - RNA, 1701 nt, Artificial Sequence; identical to SEQ ID NO: 64841
  derived and/or modified sequence opt1 from hemagglutinin__InfluenzaA__AFK14901

SEQ ID NO: 70012 - RNA, 1701 nt, Artificial Sequence; identical to SEQ ID NO: 64841
  derived and/or modified sequence opt1 from hemagglutinin__InfluenzaA__AFK14910

SEQ ID NO: 70013 - RNA, 1701 nt, Artificial Sequence; identical to SEQ ID NO: 63677
  derived and/or modified sequence opt1 from hemagglutinin__InfluenzaA__AFK14919

SEQ ID NO: 70014 - RNA, 1701 nt, Artificial Sequence; identical to SEQ ID NO: 63677
  derived and/or modified sequence opt1 from hemagglutinin__InfluenzaA__AFK14929

SEQ ID NO: 70015 - RNA, 1701 nt, Artificial Sequence; identical to SEQ ID NO: 69194
  derived and/or modified sequence opt1 from hemagglutinin__InfluenzaA__AFK25599

SEQ ID NO: 70016 - RNA, 1701 nt, Artificial Sequence
  derived and/or modified sequence opt1 from hemagglutinin__InfluenzaA__AFK25601
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgugacccugagcaccgccuccagcugguccuacaucguggagacgagcuccagcgacaacgggaccugcuaccccggcgacuucaucgacuacgaggagcuccgggagcagcuguccagcgucuccagcuucgagcgcuucgagaucuuccccaagaccuccagcuggcccaaccacgacuccaacaagggcgugaccgccgccugcccgcacgccggcgcgaagggguucuacaagaaccugaucuggcucgugaagaagggcaacagcuaccccaagcuguccaagagcuacaucaacgacaaggggaaggagguccuggugcucuggggcauccaccaccccuccacgaccgccgaccagcagagccuguaccagaacgccgacaccuacguguucgucggcaccagccgguacuccaagaaguucaagcccgagaucgccauccgcccgaaggugcgggaccaggaggggcgcaugaacuacuacuggacgcugguggagcccggcgacaagaucaccuucgaggccaccgggaaccucgucgugccccgguacgcguucgccauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgucaaguccaccaagcugcggcucgccaccgggcugcgcaacgugccgagcauccagucccggggccuguucggggcgaucgccggcuucaucgagggcggguggaccggcaugguggacgggugguacggcuaccaccaccagaacgagcaggggagcggcuacgccgccgaccucaaguccacgcagaacgccaucgacaagaucaccaacaaggucaacagcgugaucgagaagaugaacacccaguucaccgcggucggcaaggaguucaaccaccuggagaagcgcaucgagaaccugaacaagaagguggacgacggguuccucgacaucuggacguacaacgccgagcugcuggugcuccuggagaacgagcggacccuggacuaccacgacuccaacgucaagaaccucuacgagaaggugcgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagagcacccgcaucuaccagauccuggccaucuacuccaccgcggccagcucccuggugcucguggucagccugggcgccaucuccuucuggaugugcagcaacggcagccugcagugccggaucugcaucuga

SEQ ID NO: 70017 - RNA, 1701 nt, Artificial Sequence; identical to SEQ ID NO: 69194
  derived and/or modified sequence opt1 from hemagglutinin__InfluenzaA__AFK25603

SEQ ID NO: 70018 - RNA, 1701 nt, Artificial Sequence
  derived and/or modified sequence opt1 from hemagglutinin__InfluenzaA__AFK25605
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgugcgguccaccaagcugcgccucgccaccgggcugcggaacgucccgagcauccagucccgcggccuguucggggcgaucgccggcuucaucgagggcggguggaccggcaugguggacgggugguacggcuaccaccaccagaacgagcaggggagcggcuacgccgccgaccucaaguccacgcagaacgccaucgacaagaucaccaacaaggugaacagcgucaucgagaagaugaacacccaguucaccgcggugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggccaucuacuccaccgcggccagcucccugguccucguggugagccugggcgccaucuccuucuggaugugcagcaacggcagccugcagugccgcaucugcaucuga

SEQ ID NO: 70019 - RNA, 1701 nt, Artificial Sequence; identical to SEQ ID NO: 69422
  derived and/or modified sequence opt1 from hemagglutinin__InfluenzaA__AFK74526

SEQ ID NO: 70020 - RNA, 1701 nt, Artificial Sequence; identical to SEQ ID NO: 63677
  derived and/or modified sequence opt1 from hemagglutinin__InfluenzaA__AFK74534

SEQ ID NO: 70021 - RNA, 1701 nt, Artificial Sequence; identical to SEQ ID NO: 63677
  derived and/or modified sequence opt1 from hemagglutinin__InfluenzaA__AFK74544

SEQ ID NO: 70022 - RNA, 1701 nt, Artificial Sequence; identical to SEQ ID NO: 63677
  derived and/or modified sequence opt1 from hemagglutinin__InfluenzaA__AFK74554

SEQ ID NO: 70023 - RNA, 1701 nt, Artificial Sequence; identical to SEQ ID NO: 63919
  derived and/or modified sequence opt1 from hemagglutinin__InfluenzaA__AFK74564

SEQ ID NO: 70024 - RNA, 1701 nt, Artificial Sequence; identical to SEQ ID NO: 66232
  derived and/or modified sequence opt1 from hemagglutinin__InfluenzaA__AFK74575

SEQ ID NO: 70025 - RNA, 1701 nt, Artificial Sequence; identical to SEQ ID NO: 63664
  derived and/or modified sequence opt1 from hemagglutinin__InfluenzaA__AFK74585

SEQ ID NO: 70026 - RNA, 1701 nt, Artificial Sequence
  derived and/or modified sequence opt1 from hemagglutinin__InfluenzaA__AFK74595
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgaccugaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 70027 - RNA, 1701 nt, Artificial Sequence; identical to SEQ ID NO: 63677
  derived and/or modified sequence opt1 from hemagglutinin__InfluenzaA__AFK74605

SEQ ID NO: 70028 - RNA, 1701 nt, Artificial Sequence; identical to SEQ ID NO: 63919
  derived and/or modified sequence opt1 from hemagglutinin__InfluenzaA__AFK74615

SEQ ID NO: 70029 - RNA, 1701 nt, Artificial Sequence; identical to SEQ ID NO: 63919
  derived and/or modified sequence opt1 from hemagglutinin__InfluenzaA__AFK74625

SEQ ID NO: 70030 - RNA, 1701 nt, Artificial Sequence; identical to SEQ ID NO: 64779
  derived and/or modified sequence opt1 from hemagglutinin__InfluenzaA__AFK74635

SEQ ID NO: 70031 - RNA, 1701 nt, Artificial Sequence; identical to SEQ ID NO: 64779
  derived and/or modified sequence opt1 from hemagglutinin__InfluenzaA__AFK74645

SEQ ID NO: 70032 - RNA, 1701 nt, Artificial Sequence; identical to SEQ ID NO: 63677
  derived and/or modified sequence opt1 from hemagglutinin__InfluenzaA__AFK74655

SEQ ID NO: 70033 - RNA, 1701 nt, Artificial Sequence; identical to SEQ ID NO: 63677
  derived and/or modified sequence opt1 from hemagglutinin__InfluenzaA__AFK74665

SEQ ID NO: 70034 - RNA, 1701 nt, Artificial Sequence; identical to SEQ ID NO: 63677
  derived and/or modified sequence opt1 from hemagglutinin__InfluenzaA__AFK74675

SEQ ID NO: 70035 - RNA, 1701 nt, Artificial Sequence; identical to SEQ ID NO: 63677
  derived and/or modified sequence opt1 from hemagglutinin__InfluenzaA__AFK74685

SEQ ID NO: 70036 - RNA, 1701 nt, Artificial Sequence; identical to SEQ ID NO: 66232
  derived and/or modified sequence opt1 from hemagglutinin__InfluenzaA__AFK74695

SEQ ID NO: 70037 - RNA, 1701 nt, Artificial Sequence; identical to SEQ ID NO: 63677
  derived and/or modified sequence opt1 from hemagglutinin__InfluenzaA__AFK74705

SEQ ID NO: 70038 - RNA, 1701 nt, Artificial Sequence; identical to SEQ ID NO: 63677
  derived and/or modified sequence opt1 from hemagglutinin__InfluenzaA__AFK74715

SEQ ID NO: 70039 - RNA, 1701 nt, Artificial Sequence; identical to SEQ ID NO: 63677
  derived and/or modified sequence opt1 from hemagglutinin__InfluenzaA__AFK74725

SEQ ID NO: 70040 - RNA, 1701 nt, Artificial Sequence; identical to SEQ ID NO: 63677
  derived and/or modified sequence opt1 from hemagglutinin__InfluenzaA__AFK74735

SEQ ID NO: 70041 - RNA, 1701 nt, Artificial Sequence; identical to SEQ ID NO: 63677
  derived and/or modified sequence opt1 from hemagglutinin__InfluenzaA__AFK74745

SEQ ID NO: 70042 - RNA, 1701 nt, Artificial Sequence; identical to SEQ ID NO: 63677
  derived and/or modified sequence opt1 from hemagglutinin__InfluenzaA__AFK74755

SEQ ID NO: 70043 - RNA, 1701 nt, Artificial Sequence; identical to SEQ ID NO: 66232
  derived and/or modified sequence opt1 from hemagglutinin__InfluenzaA__AFK74765

SEQ ID NO: 70044 - RNA, 1701 nt, Artificial Sequence; identical to SEQ ID NO: 63677
  derived and/or modified sequence opt1 from hemagglutinin__InfluenzaA__AFK74775

SEQ ID NO: 70045 - RNA, 1701 nt, Artificial Sequence; identical to SEQ ID NO: 63677
  derived and/or modified sequence opt1 from hemagglutinin__InfluenzaA__AFK74785

SEQ ID NO: 70046 - RNA, 1701 nt, Artificial Sequence; identical to SEQ ID NO: 63677
  derived and/or modified sequence opt1 from hemagglutinin__InfluenzaA__AFK74795

SEQ ID NO: 70047 - RNA, 1701 nt, Artificial Sequence; identical to SEQ ID NO: 63677
  derived and/or modified sequence opt1 from hemagglutinin__InfluenzaA__AFK74805

SEQ ID NO: 70048 - RNA, 1701 nt, Artificial Sequence; identical to SEQ ID NO: 63677
  derived and/or modified sequence opt1 from hemagglutinin__InfluenzaA__AFK74815

SEQ ID NO: 70049 - RNA, 1701 nt, Artificial Sequence; identical to SEQ ID NO: 63677
  derived and/or modified sequence opt1 from hemagglutinin__InfluenzaA__AFK74825

SEQ ID NO: 70050 - RNA, 1701 nt, Artificial Sequence; identical to SEQ ID NO: 63677
  derived and/or modified sequence opt1 from hemagglutinin__InfluenzaA__AFK74835

SEQ ID NO: 70051 - RNA, 1701 nt, Artificial Sequence; identical to SEQ ID NO: 63677
  derived and/or modified sequence opt1 from hemagglutinin__InfluenzaA__AFK74845

SEQ ID NO: 70052 - RNA, 1701 nt, Artificial Sequence; identical to SEQ ID NO: 63677
  derived and/or modified sequence opt1 from hemagglutinin__InfluenzaA__AFK74895

SEQ ID NO: 70053 - RNA, 1701 nt, Artificial Sequence; identical to SEQ ID NO: 63677
  derived and/or modified sequence opt1 from hemagglutinin__InfluenzaA__AFK74905

SEQ ID NO: 70054 - RNA, 1701 nt, Artificial Sequence; identical to SEQ ID NO: 63677
  derived and/or modified sequence opt1 from hemagglutinin__InfluenzaA__AFK74915

SEQ ID NO: 70055 - RNA, 1701 nt, Artificial Sequence
  derived and/or modified sequence opt1 from hemagglutinin__InfluenzaA__AFK74925
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgcggccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucacgauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacggcaucaccaacaaggucaacuccgugaucgagaagaugaacacgcaguucaccgccgucggcaaggaguucaaccaccuggagaagcgcaucgagaaccugaacaagaagaucgacgacggguuccucgacaucuggaccuacaacgcggagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgccagcagccuggugcucguggucucccugggcgcgaucagcuucuggaugugcuccaacggcagccugcagugccggaucugcaucuga

SEQ ID NO: 70056 - RNA, 1701 nt, Artificial Sequence; identical to SEQ ID NO: 64779
  derived and/or modified sequence opt1 from hemagglutinin__InfluenzaA__AFK74935

SEQ ID NO: 70057 - RNA, 1701 nt, Artificial Sequence; identical to SEQ ID NO: 63677
  derived and/or modified sequence opt1 from hemagglutinin__InfluenzaA__AFK74945

SEQ ID NO: 70058 - RNA, 1701 nt, Artificial Sequence; identical to SEQ ID NO: 63677
  derived and/or modified sequence opt1 from hemagglutinin__InfluenzaA__AFK74955

SEQ ID NO: 70059 - RNA, 1701 nt, Artificial Sequence; identical to SEQ ID NO: 63677
  derived and/or modified sequence opt1 from hemagglutinin__InfluenzaA__AFK74965

SEQ ID NO: 70060 - RNA, 1701 nt, Artificial Sequence; identical to SEQ ID NO: 63768
  derived and/or modified sequence opt1 from hemagglutinin__InfluenzaA__AFK74975

SEQ ID NO: 70061 - RNA, 1701 nt, Artificial Sequence; identical to SEQ ID NO: 63677
  derived and/or modified sequence opt1 from hemagglutinin__InfluenzaA__AFK74985

SEQ ID NO: 70062 - RNA, 1701 nt, Artificial Sequence; identical to SEQ ID NO: 66232
  derived and/or modified sequence opt1 from hemagglutinin__InfluenzaA__AFK74995

SEQ ID NO: 70063 - RNA, 1701 nt, Artificial Sequence; identical to SEQ ID NO: 63677
  derived and/or modified sequence opt1 from hemagglutinin__InfluenzaA__AFK75005

SEQ ID NO: 70064 - RNA, 1701 nt, Artificial Sequence
  derived and/or modified sequence opt1 from hemagglutinin__InfluenzaA__AFK75015
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcguguga

SEQ ID NO: 70065 - RNA, 1701 nt, Artificial Sequence; identical to SEQ ID NO: 63919
  derived and/or modified sequence opt1 from hemagglutinin__InfluenzaA__AFK75025

SEQ ID NO: 70066 - RNA, 1701 nt, Artificial Sequence; identical to SEQ ID NO: 63919
  derived and/or modified sequence opt1 from hemagglutinin__InfluenzaA__AFK75035

SEQ ID NO: 70067 - RNA, 1701 nt, Artificial Sequence; identical to SEQ ID NO: 63919
  derived and/or modified sequence opt1 from hemagglutinin__InfluenzaA__AFK75045

SEQ ID NO: 70068 - RNA, 1701 nt, Artificial Sequence; identical to SEQ ID NO: 63919
  derived and/or modified sequence opt1 from hemagglutinin__InfluenzaA__AFK75055

SEQ ID NO: 70069 - RNA, 1701 nt, Artificial Sequence; identical to SEQ ID NO: 63677
  derived and/or modified sequence opt1 from hemagglutinin__InfluenzaA__AFK75065

SEQ ID NO: 70070 - RNA, 1701 nt, Artificial Sequence; identical to SEQ ID NO: 63677
  derived and/or modified sequence opt1 from hemagglutinin__InfluenzaA__AFK75075

SEQ ID NO: 70071 - RNA, 1701 nt, Artificial Sequence; identical to SEQ ID NO: 64841
  derived and/or modified sequence opt1 from hemagglutinin__InfluenzaA__AFK75085

SEQ ID NO: 70072 - RNA, 1701 nt, Artificial Sequence; identical to SEQ ID NO: 64841
  derived and/or modified sequence opt1 from hemagglutinin__InfluenzaA__AFK75095

SEQ ID NO: 70073 - RNA, 1701 nt, Artificial Sequence; identical to SEQ ID NO: 63677
  derived and/or modified sequence opt1 from hemagglutinin__InfluenzaA__AFK75105

SEQ ID NO: 70074 - RNA, 1701 nt, Artificial Sequence; identical to SEQ ID NO: 63919
  derived and/or modified sequence opt1 from hemagglutinin__InfluenzaA__AFK77857

SEQ ID NO: 70075 - RNA, 1701 nt, Artificial Sequence; identical to SEQ ID NO: 63919
  derived and/or modified sequence opt1 from hemagglutinin__InfluenzaA__AFK77867

SEQ ID NO: 70076 - RNA, 1701 nt, Artificial Sequence; identical to SEQ ID NO: 69205
  derived and/or modified sequence opt1 from hemagglutinin__InfluenzaA__AFK77877

SEQ ID NO: 70077 - RNA, 1701 nt, Artificial Sequence; identical to SEQ ID NO: 63677
  derived and/or modified sequence opt1 from hemagglutinin__InfluenzaA__AFK77887

SEQ ID NO: 70078 - RNA, 1701 nt, Artificial Sequence
  derived and/or modified sequence opt1 from hemagglutinin__InfluenzaA__AFK77897
augaaggccauccuggugguccuccuguacaccuucgccaccgcgaacgccgacacgcugugcaucggcuaccacgccaacaacagcaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacguccaaguacagcaagaaguucaagcccgagaucgccgugcggccgaagguccgcgaccaggagggccggaugaacuacuacuggacccugguggagcccggggacaagaucaccuucgaggcgaccggcaaccuccuggugccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacagcaacgugaagaaccuguacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgcgaggagaucgacggcgugaagcuggagagcacccggaucuaccagauccuggcgaucuacuccaccguggccagcagccucguccugguggugucccugggggccaucagcuucuggaugugcuccaacggcagccuccagugccgcaucugcaucuga

SEQ ID NO: 70079 - RNA, 1701 nt, Artificial Sequence; identical to SEQ ID NO: 68058
  derived and/or modified sequence opt1 from hemagglutinin__InfluenzaA__AFK78028

SEQ ID NO: 70080 - RNA, 1701 nt, Artificial Sequence; identical to SEQ ID NO: 63919
  derived and/or modified sequence opt1 from hemagglutinin__InfluenzaA__AFK78187

SEQ ID NO: 70081 - RNA, 1701 nt, Artificial Sequence; identical to SEQ ID NO: 67863
  derived and/or modified sequence opt1 from hemagglutinin__InfluenzaA__AFM45476

SEQ ID NO: 70082 - RNA, 1701 nt, Artificial Sequence
  derived and/or modified sequence opt1 from hemagglutinin__InfluenzaA__AFM45487
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 70083 - RNA, 1701 nt, Artificial Sequence; identical to SEQ ID NO: 67863
  derived and/or modified sequence opt1 from hemagglutinin__InfluenzaA__AFM45489

SEQ ID NO: 70084 - RNA, 1701 nt, Artificial Sequence; identical to SEQ ID NO: 70082
  derived and/or modified sequence opt1 from hemagglutinin__InfluenzaA__AFM45494

SEQ ID NO: 70085 - RNA, 1701 nt, Artificial Sequence
  derived and/or modified sequence opt1 from hemagglutinin__InfluenzaA__AFM68954
augaaggcccgccugcucgugcugcugugcgcccucgcggccaccgacgccgacaccaucugcaucggcuaccacgccaacaacagcacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggagcugguccuacaucguggagacccccaacagcgagaacggcgccugcuaccccggcgacuucaucgacuacgaggagcugaaggagcagcuguccagcguguccagccucgagcgcuucgagaucuucccgaaggaguccagcuggcccaaccacaacacccugaagggggucaccgccuccugcagccacggcgggaaguccagcuucuaccggaaccugcucuggcugacgaagaccgaggacuccuaccccaagcugagcaacuccuacgugaacaacaagggcaaggaggugcucguccuguggggcgugcaccaccccagcagcuccgacgagcagcagagccuguaccacaacgugaacgcguacgucuccguggugagcuccaacuacaacgggcgcuucaccccggagaucgccgcccggcccaagguccgcaaccagcccggccggaugaacuacuacuggacccuccuggagcccggggacacgaucaucuucgaggccaccggcaaccugaucgccccgugguacgcguucgcccucagccgcggguucggcuccggcaucaucaccagcaacgccuccaugcacgagugcaacaccaagugccagacgccccagggggccaucaacagcucccugcccuuccagaacauccaccccgugaccaucggcgagugcccgaaguacgugcggagcaccaagcugcgcauggucaccgggcuccggaacauccccuccauccaguuccgcggccuguucggggccaucgcgggcuucaucgagggcggguggacgggcaugaucgacgggugguacggcuaccaccaccagaacgagcaggggagcggcuacgccgccgaccagaaguccacccagaacgccaucaacggcaucaccaacaaggugaacagcgugaucgagaagaugaacacccaguucacggccgucuccaaggaguucaacaaccuggagaagcggauggagaaccucaacaagaagguggacgacggguuccuggacaucuggaccuacaacgcggagcugcucgugcugcuggagaacgagcgcacccucgacuuccacgaccugaacgucaagaaccuguacgagaaggucaagagccagcucaagaacaacgccaaggagaucggcaacgggugcuucgaguucuaccacaagugcgacaacaagugcauggaguccgugcggaacggcaccuacgacuaccccaaguacagcgaggagagcaagcugaaccgcgagaagaucgacggggugaagcuggaguccaugggcguguaccagauccucgccaucuacagcacggucgccuccagccuggugcugcuggugucccucggcgccaucagcuucuggaugugcuccaacgggagccugcagugccggaucugcaucuga

SEQ ID NO: 70086 - RNA, 1701 nt, Artificial Sequence
  derived and/or modified sequence opt1 from hemagglutinin__InfluenzaA__AFM68965
augaagaccaucaucgcccugagcuacaucuucugccaggugcucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagaacgggggcagcuacgccugcaagcgcgggcccgacaacuccuucuucagccggcugaacuggcucuacaaguccgagagcaccuaccccgugcugaacgucacgaugcccaacaacgacaacuucgacaagcuguacaucuggggcgugcaccacccguccaccgacaaggagcagaccaaccucuacgugcaggccagcggccgcgucaccguguccacgaagcggagccagcagaccaucauccccaacguggggagccgccccuggguccggggccuguccagcgggaucuccaucuacuggaccaucgugaagcccggcgacauccugcucaucaacagcaacggcaaccugaucgcgccgcgcggguacuucaagauccggaccggcaaguccagcaucaugcgcuccgacgcccccaucgggacgugcagcuccgagugcaucacccccaacggcagcauccccaacgacaagccguuccagaacgugaacaagaucaccuacggggccugccccaaguacgucaagcagaacacccugaagcucgccacgggcaugcggaacgugcccgagaagcagacccgcggcaucuucggggccaaggcgggcuucaucgagaacgggugggagggcaugaucgacgggugguacggcuuccggcaccagaacuccgagggcaccgggcaggccgccgaccucaagagcacccaggccgccaucgaccagaucaacggcaagcugaaccgcgugaucgagaagacgaacgagaaguuccaccagaucgagaaggaguucuccgaggucgaggggcggauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcgccggcagcugcgcgagaacgccgaggacaugggcaacgggugcuucaagaucuaccacaagugcgacaacgccugcaucggcagcauccggaacggcaccuacgaccacgacgucuaccgcgacgaggcccugaacaaccgcuuccagaucaaggggguggagcucaaguccggcuacaaggacuggauccuguggaucagcuucgcgaucuccugcuuccugcucugcgucgugcugcugggguucaucaugugggccugccagaagggcaacauccggugcaacaucugcaucuga

SEQ ID NO: 70087 - RNA, 1701 nt, Artificial Sequence
  derived and/or modified sequence opt1 from hemagglutinin__InfluenzaA__AFM68987
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgacaaguccuucuucagccggcugaacuggcucuacgaguccgagagcaaguaccccgugcugaacgucaccaugcccaacaacggcaacuucgacaagcuguacaucuggggcgugcaccaccccuccacggacaaggagcagaccaaccucuacgugcgcgccagcgggcgggucaccgugagcaccaagcgcucccagcagacggugaucccgaacaucggcagccggcccuggguccgcgggcuguccagccggaucuccaucuacuggaccaucgugaagcccggcgacauccugcucaucaacagcaacggcaaccugaucgcgccccgcggguacuucaagauccggaccggcaaguccagcaucaugcgcuccgacgccccgaucgggaccugcagcuccgagugcaucacgcccaacggcagcauccccaacgacaagcccuuccagaacgugaacaagaucaccuacggggccugcccgaaguacgucaagcagaacacccugaagcucgccaccggcaugcggaacgugcccgagaagcagacgcgcggcaucuucggggccaucgcgggcuucaucgagaacgggugggagggcaugguggacgggugguacggcuuccggcaccagaacuccgagggcaccgggcaggccgccgaccucaagagcacccaggccgccaucgaccagaucaacggcaagcugaaccgcgucaucgagaagaccaacgagaaguuccaccagaucgagaaggaguucuccgagguggaggggcggauccaggaccucgagaaguacguggaggacacgaagaucgaccuguggagcuacaacgcggagcugcucgucgcccuggagaaccagcacaccaucgaccugaccgacuccgagaugaacaagcuguucgagaagacccgccggcagcugcgcgagaacgccgaggacaugggcaacgggugcuucaagaucuaccacaagugcgacaacgccugcaucggcagcauccgcaacggcacguacgaccacgacguguaccgggacgaggcccugaacaaccgcuuccagaucaagggggucgagcucaaguccggcuacaaggacuggauccuguggaucagcuucgcgaucagcugcuuccugcucugcguggugcugcugggguucaucaugugggccugccagaagggcaacauccggugcaacaucugcaucuga

SEQ ID NO: 70088 - RNA, 1701 nt, Artificial Sequence
  derived and/or modified sequence opt1 from hemagglutinin__InfluenzaA__AFM71720
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcuccacgaguccgaguacaaguaccccgcccugaacgucgcgaugcccaacaacgggaaguucgacaagcuguacaucuggggcgugcaccaccccaucaccgaccgcgagcagacgaaccucuacgugcgggccagcggccgcgucaccguguccaccaagcggagccagcagaccgugaucccgaacaucgggagccgccccuggguccggggccuguccagccgcaucuccaucuacuggacgaucgugaagcccggggacauccuguucaucaacagcaccggcaaccucaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaacaagaucaccuacggcgccugcccgcgcuacgucaagcagaacacccugaagcuggccaccgggaugcggaacgugcccgagaagcagacgcgcggcaucuucggcgccaucgccggguucaucgagaacggcugggaggggaugguggacggcugguacggguuccggcaccagaacuccgagggcaccggccaggccgccgaccucaagagcacccaggcggccaucgaccagaucaacgggaagcugaaccgccugaucgagaagaccaacgagaaguuccaccagaucgagaaggaguucuccgaggucgagggccggauccaggaccucgagaaguacguggaggacacgaagaucgaccuguggagcuacaacgccgagcugcucguggcccuggagaaccagcacaccaucgaccugaccgacuccgagaugaacaagcuguucgagaagacccgcaagcagcuccgcgagaacgccgaggacauggggaacggcugcuucaagaucuaccacaagugcgacaacgcgugcaucgggagcauccggaacggcacguacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 70089 - RNA, 1701 nt, Artificial Sequence
  derived and/or modified sequence opt1 from hemagglutinin__InfluenzaA__AFM71731
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgaguccuacgccugcaagcgcgggagcgugaaguccuucuucagccggcucaacuggcugcacaaguccgaguacaaguaccccgcgcugaacgucaccaugcccaacaacggcaaguucgacaagcucuacaucuggggcgugcaccaccccagcaccgaccgcgagcagacgaaccuguacgugcgggccuccgggcgcgucaccgugagcaccaagcggagccagcagaccgugaucccgaacaucggcucccgccccuggguccgggggcugagcucccgcaucagcaucuacuggacgaucgugaagcccggcgacauccuccugaucaacuccaccgggaaccugaucgcgccccggggcuacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 70090 - RNA, 1701 nt, Artificial Sequence
  derived and/or modified sequence opt1 from hemagglutinin__InfluenzaA__AFM71754
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucaccguguccacgaagcgcagccagcagaccgccauccccaacaucggcagccggccccgcgugcggaacauccccucccgcaucagcaucuacuggaccaucgucaagccgggcgacauccugcugaucaacuccaccgggaaccucaucgcgccccggggcuacuucaagauccgcagcgggaaguccagcaucaugcgguccgacgcccccaucggcaagugcaacagcgagugcaucacgcccaacggcuccaucccgaacgacaagcccuuccagaacgugaaccgcaucaccuacggggccugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgcccacgacguguaccgggacgaggcccugaacaaccgcuuccagaucaagggggucgagcucaagagcggcuacaaggacuggauccuguggaucuccuucgccaucagcugcuuccugcucugcguggcgcugcugggcuucaucaugugggccugccagaaggggaacauccggugcaacaucugcaucuga

SEQ ID NO: 70091 - RNA, 1701 nt, Artificial Sequence
  derived and/or modified sequence opt1 from hemagglutinin__InfluenzaA__AFM71768
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacgacuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccagcggccggaucaccguguccacgaagcgcagccagcagaccgccauccccaacaucgggagccggccccgcgugcggaacauccccucccgcaucagcaucuacuggaccaucgucaagccgggcgacauccugcugaucaacuccaccggcaaccucaucgcgccccggggguacuucaagauccgcagcggcaaguccagcaucaugcgguccgacgcccccaucgggaagugcaacagcgagugcaucacgcccaacggcuccaucccgaacgacaagcccuuccagaacgugaaccgcaucaccuacggcgccugcccccgguacgugaagcagaacacccugaagcuggccaccgggaugcgcaacguccccgagaagcagacgcggggcaucuucggggccaucgccggcuucaucgagaacgggugggagggcaugguggacggcugguacggguuccgccaccagaacagcgagggccgggggcaggccgcggaccucaaguccacccaggccgccaucgaccagaucaacggcaagcugaaccgccugaucgggaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgcccacgacguguaccgggacgaggcccugaacaaccgcuuccagaucaagggcgucgagcucaagagcggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 70092 - RNA, 1701 nt, Artificial Sequence
  derived and/or modified sequence opt1 from hemagglutinin__InfluenzaA__AFM71791
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccggggagaucugcgacagcccccaccagauccucgacggcaagaacugcacgcugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucacgguguccaccaagcgcagccagcagaccgugauccccaacaucggcagccggccccgcguccggaacauccccucccgcaucagcaucuacuggaccaucgugaagccgggcgacauccugcugaucaacuccacggggaaccucaucgcgccccggggcuacuucaagauccgcagcgggaaguccagcaucaugcgguccgacgcccccaucggcaagugcaacagcgagugcaucacccccaacggcuccaucccgaacgacaagcccuuccagaacgugaaccgcaucaccuacggggccugcccccgguacgucaagcagaacacccugaagcuggccacgggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagaccaacgagaaguuccaccagaucgagaaggaguucagcgaggucgagggccggauccaggaccucgagaaguacguggaggacacgaagaucgaccugugguccuacaacgccgagcugcucguggcccuggagaaccagcacaccaucgagcugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcacguacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 70093 - RNA, 1701 nt, Artificial Sequence
  derived and/or modified sequence opt1 from hemagglutinin__InfluenzaA__AFM71824
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucaccguguccacgaagcgcagccagcagaccgccauccccaacaucggcagccggccccgcgugcggaacauccccucccgcaucagcaucuacuggaccaucgucaagccgggcgacauccugcugaucaacuccaccgggaaccucaucgcgccccggggcuacuucaagauccgcagcgggaaguccagcaucaugcgguccgacgcccccaucggcaagugcaacagcgagugcaucacgcccaacggcuccaucccgaacgacaagcccuuccagaacgugaaccgcaucaccuacggggccugcccccgguacgugaagcagaacacccugaagcuggccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 70094 - RNA, 1701 nt, Artificial Sequence
  derived and/or modified sequence opt1 from hemagglutinin__InfluenzaA__AFM71835
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccagcugcuaccccuacgacgugccggacuacgcgucccugcggagccucgucgccuccagcggcacgcuggaguucaacuccgagagcuucaacuggaccggggugacccagaacggcaccuccagcgccugcauccgccgguccuacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucaccgugagcacgaagcgcucccagcaggccgugauccccaacaucggcagccggccccgcguccggaacauccccucccgcaucagcaucuacuggaccaucgugaagccgggcgacauccugcugaucaacuccaccgggaaccucaucgcgccccggggcuacuucaagauccgcagcgggaaguccagcaucaugcgguccgacgcccccaucggcaagugcaacagcgagugcaucacccccaacggcuccaucccgaacgacaagcccuuccagaacgugaaccgcaucacguacggggccugcccccgguacaucaagcagagcacccugaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcucaaguccggcuacaaggacuggauccuguggaucagccuggccaucagcugcuuccuccugugcguggcccugcucggcuucaucaugugggcgugccagaaggggaacauccggugcaacaucugcaucuga

SEQ ID NO: 70095 - RNA, 1698 nt, Artificial Sequence
  derived and/or modified sequence opt1 from hemagglutinin__InfluenzaA__AFM71846
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacagcuacgucaacaagaagggcaaggaggugcucgugcugugggggauccaccacccguccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacagcucccugcccuaccagaacauccaccccgugaccaucggggagugcccgaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 70096 - RNA, 1701 nt, Artificial Sequence; identical to SEQ ID NO: 63326
  derived and/or modified sequence opt1 from hemagglutinin__InfluenzaA__AFM71857

SEQ ID NO: 70097 - RNA, 1701 nt, Artificial Sequence
  derived and/or modified sequence opt1 from hemagglutinin__InfluenzaA__AFM71868
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcuccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgugaccgacaacgaccagauccggcuguacgcccaggcguccgggcgcaucaccgugagcacgaagcggagccagcagaccgucaucccgaacaucggcucccgcccccgggugcgcgacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgucaaccggaucaccuacggggccugcccccgcuacgugaagcagaacacccugaagcucgccaccggcaugcggaacgugcccgagaagcagacgcgcgggaucuucggcgcgaucgccggguucaucgagaacggcugggagggcauggucgacgggugguacggcuuccggcaccagaacuccgaggggaucggccaggccgccgaccucaagagcacccaggccgcgaucaaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 70098 - RNA, 1701 nt, Artificial Sequence; identical to SEQ ID NO: 68006
  derived and/or modified sequence opt1 from hemagglutinin__InfluenzaA__AFM71879

SEQ ID NO: 70099 - RNA, 1701 nt, Artificial Sequence
  derived and/or modified sequence opt1 from hemagglutinin__InfluenzaA__AFM71890
augaaggcccgccugcucgugcugcugugcgcccucgcggccaccgacgccgacaccaucugcaucggcuaccacgccaacaacagcacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggagcugguccuacaucguggagacccccaacagcgagaacggcgccugcuaccccggcgacuucaucgacuacgaggagcugaaggagcagcuguccagcguguccagccucgagcgcuucgagaucuucccgaaggaguccagcuggcccaaccacaacacccugaagggggucaccgccuccugcagccacggcgggaaguccagcuucuaccggaaccugcucuggcugacgaagaccgaggacuccuaccccaagcugagcaacuccuacgugaacaacaagggcaaggaggugcucguccuguggggcgugcaccaccccagcagcuccgacgagcagcagagccuguaccacaacgugaacgcguacgucuccguggugagcuccaacuacaaccgccgguucaccccggagaucgccgcccgccccaagguccggaaccagcccgggcgcaugaacuacuacuggacccuccuggagcccggcgacacgaucaucuucgaggccaccgggaaccugaucgccccgugguacgcguucgcccucagccggggcuucggguccggcaucaucaccagcaacgccuccaugcacgagugcaacaccaagugccagacgccccagggcgccaucaacagcucccugcccuuccagaacauccaccccgugaccaucggggagugcccgaaguacgugcgcagcaccaagcugcggauggucaccggccuccgcaacauccccuccauccaguuccgggggcuguucggcgccaucgcgggguucaucgagggcggcuggacggggaugaucgacggcugguacggguaccaccaccagaacgagcagggcagcggguacgccgccgaccagaaguccacccagaacgccaucaacggcaucaccaacaaggugaacagcgugaucgagaagaugaacacccaguucacggccgucuccaaggaguucaacaaccuggagaagcgcauggagaaccucaacaagaagguggacgacggcuuccuggacaucuggaccuacaacgcggagcugcucgugcugcuggagaacgagcggacccucgacuuccacgaccugaacgucaagaaccuguacgagaaggucaagagccagcucaagaacaacgccaaggagaucgggaacggcugcuucgaguucuaccacaagugcgacaacaagugcauggaguccgugcgcaacgggaccuacgacuaccccaaguacagcgaggagagcaagcugaaccgggagaagaucgacggcgugaagcuggaguccauggggguguaccagauccucgccaucuacagcacggucgccuccagccuggugcugcuggugucccucggcgccaucagcuucuggaugugcuccaacggcagccugcagugccgcaucugcaucuga

SEQ ID NO: 70100 - RNA, 1701 nt, Artificial Sequence; identical to SEQ ID NO: 70085
  derived and/or modified sequence opt1 from hemagglutinin__InfluenzaA__AFM71901

SEQ ID NO: 70101 - RNA, 1701 nt, Artificial Sequence
  derived and/or modified sequence opt1 from hemagglutinin__InfluenzaA__AFM71923
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacuccuuccagaacgagacgugggaccuguucguggagcggagcaaggccuucuccaacugcuaccccuacgacgugccggacuacgccagccuccgcucccuggucgcgagcuccggcacccuggaguucaucaacgagggguucaccuggaccggcgugacgcagaacgggggcagcaacgccugcaagcgggggcccgacuccggcuucuucagccgccucaacuggcuguacaaguccggcagcaccuaccccgugcugaacgucaccaugcccaacaacgacaacuucgacaagcucuacaucuggggcgugcaccacccguccaccaaccaggagcagacgagccuguacgugcaggccuccggccgggucaccgugagcaccaagcgcagccagcagaccaucauccccaacaucgggucccggcccugggugcgcggccugagcucccggaucagcaucuacuggacgaucgucaagcccggcgacauccucgugaucaacuccaacgggaaccugaucgccccgcgcggcuacuucaagaugcggaccggcaagagcuccaucaugcgcagcgacgcgcccaucgggaccugcaucuccgagugcaucacccccaacgggagcauccccaacgacaagccguuccagaacgugaacaagaucacguacggggccugccccaaguacgucaagcagaacacccugaagcucgccaccggcaugcggaacgugcccgagaagcagacccgcgggcuguucggcgccaucgccggguucaucgagaacggcugggaggggaugaucgacggcugguacggcuuccggcaccagaacuccgaggggacgggccaggcggccgaccucaagagcacccaggccgccaucgaccagaucaacgggaagcugaaccgcgugaucgagaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacacgaucgaccucaccgacuccgagaugaacaagcuguucgagaagacccgccggcagcugcgcgagaacgccgaggacauggggaacggcugcuuccggaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 70102 - RNA, 1701 nt, Artificial Sequence
  derived and/or modified sequence opt1 from hemagglutinin__InfluenzaA__AFM71934
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaacgagggcuucaccuggaccggggugacgcagaacggcggguccaacgccugcaagcggggccccgacagcggcuucuucucccgccucaacuggcuguacaagagcggguccaccuaccccgugcugaacgucaccaugcccaacaacgacaacuucgacaagcucuacaucuggggcgugcaccacccgagcaccaaccaggagcagacgucccuguacgugcaggccagcgggcgggucaccguguccaccaagggcagccagcagaccaucauccccaacaucggcagccgccccugggugcgggggcuguccagccgcaucuccaucuacuggacgaucgucaagcccggcgacauccucgugaucaacagcaacgggaaccugaucgccccgcggggcuacuucaagaugcgcaccgggaaguccagcaucaugcgguccgacgcgcccaucgggaccugcaucagcgagugcaucacccccaacggcuccauccccaacgacaagccguuccagaacgugaacaagaucacguacggcgccugccccaaguacgucaagcagaacacccugaagcucgccaccggcaugcgcaacgugcccgagaagcagacccgggggcuguucggcgccaucgccggguucaucgagaacggcugggagggcaugaucgacgggugguacggcuuccgccaccagaacagcgaggggacgggccaggcggccgaccugaaguccacccaggccgccaucgaccagaucaacgggaagcucaaccgggugaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacacgaucgaccucaccgacagcgagaugaacaagcuguucgagaagacccggcgccagcugcgggagaacgccgaggacaugggcaacgggugcuuccgcaucuaccacaagugcgacaacgccugcaucggcuccauccggaacgggaccuacgaccacgacgucuaccgcgacgaggcccucaacaaccgcuuccagaucaagggcguggagcucaagagcggcuacaaggacuggauccuguggaucuccuucgccaucagcugcuuccugcugugcgucgugcugcucggguucaucaugugggcgugccagaagggcaacauccggugcaacaucugcaucuga

SEQ ID NO: 70103 - RNA, 1701 nt, Artificial Sequence
  derived and/or modified sequence opt1 from hemagglutinin__InfluenzaA__AFM71945
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucaacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacagcggcuucuucucccgccugaacuggcucuacaagagcggguccgccuaccccgugcugaacgucaccaugcccaacaacgacaacuucgacaagcuguacaucuggggcgugcaccacccgagcaccgaccaggagcagaccaaccucuacgugcaggccuccgggcgggucacggugagcaccaagcgcucccagcagaccaucauccccaacaucggcagccggcccugggugcgcggccugagcucccggaucagcaucuacuggaccaucgucaagcccggggacauccuggugaucaacuccaacggcaaccucaucgcgccgcgcggguacuucaagaugcggacgggcaagagcuccaucaugcgcagcgacgcccccaucgggaccugcaucuccgagugcaucacccccaacggcagcauccccaacgacaagccguuccagaacgugaacaagaucaccuacggcgccugccccaaguacgucaagcagaacacgcugaagcuggccaccgggaugcggaacgugcccgagaagcagacccgcggcaucuucggggccaucgcgggcuucaucgagaacgggugggagggcaugaucgacggcugguacggguuccggcaccagaacuccgagggcaccgggcaggccgccgaccucaagagcacgcaggccgccaucgaccagaucaacggcaagcugaaccgcgugaucgagaagaccaacgagaaguuccaccagaucgagaaggaguucuccgaggucgaggggcggauccaggaccuggagaaguacguggaggacaccaagaucgaccucuggagcuacaacgcggagcugcugguggcccucgagaaccagcacaccaucgaccugacggacuccgagaugaacaagcuguucgagaagacccgccggcagcuccgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcugaaguccggcuacaaggacuggauccucuggaucagcuucgcgaucuccugcuuccugcugugcgucgugcuccugggcuucaucaugugggccugccagaaggggaacauccggugcaacaucugcaucuga

SEQ ID NO: 70104 - RNA, 1701 nt, Artificial Sequence; identical to SEQ ID NO: 70103
  derived and/or modified sequence opt1 from hemagglutinin__InfluenzaA__AFM71956

SEQ ID NO: 70105 - RNA, 1704 nt, Artificial Sequence
  derived and/or modified sequence opt1 from hemagglutinin__InfluenzaA__AFM71978
augaagaccaucaucgcccugagcuacaucuucugccucguguucgcccaggaccugcccggcaacgacaacaacuccaccgcgacgcugugccucgggcaccacgccgucccgaacggcacccuggugaagaccaucaccaacgaccagaucgaggugacgaacgccaccgagcugguccagagcuccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccaacgccugcaagcgggggcccgacagcggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccaaccuguacgugcaggccagcgggaaggucaccguguccacgaagcggagccagcagaccaucauccccaacguggggagccgccccuggguccggggccucuccagccgcaucuccaucuacuggaccaucgugaagcccggcgacauccuggugaucaacagcaacgggaaccugaucgcgccgcggggcuacuucaagaugcgcaccgggaaguccagcaucaugcgguccgacgcccccaucggcacgugcagcuccgagugcaucacccccaacgggagcauccccaacgacaagccguuccagaacgucaacaagaucaccuacggcgccugccccaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaagggcaacauccgcugcaacaucugcaucuga

SEQ ID NO: 70106 - RNA, 1701 nt, Artificial Sequence
  derived and/or modified sequence opt1 from hemagglutinin__InfluenzaA__AFM71989
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccagcaccgacaaggaccagaucuuccuguacacccaggcggccgggcggaucacgguguccaccaagcgcagccagcaggccgugaucccgaacaucgggagccggccccgcguccggaacauccccucccgcgugagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgcgugcaucacgcccaacggcuccauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacagcgagggccgggggcaggcggccgaccugaaguccacccaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgcgcugcucggcuucaucaugugggccugccagaagggcaacauccggugcaacaucugcaucuga

SEQ ID NO: 70107 - RNA, 1701 nt, Artificial Sequence
  derived and/or modified sequence opt1 from hemagglutinin__InfluenzaA__AFM72010
augaagaccaucaucgcccugagcuacaucuucugccaggugcucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagaacgggggcagcuacgccugcaagcgcgggcccgacaaguccuucuucagccggcugaacuggcucuacgaguccgagagcaccuaccccgugcugaacgucacgaugcccaacaacgacaacuucgacaagcuguacaucuggggcgugcaccacccguccaccgacaaggagcagaccaagcucuacgugcaggccagcggccgcgucaccguguccacgaagcggagccagcagaccaucauccccaacguggggagccgccccuggguccggggccuguccagccgcaucuccaucuacuggaccaucgugaagcccggggacauccugcucaucaacagcaacggcaaccugaucgcgccgcggggcuacuucaagauccgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccugaagcucgccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcggcgccagcugcgggagaacgccgaggacauggggaacggcugcuucaagaucuaccacaagugcgacaacgccugcaucgggagcauccgcaacggcaccuacgaccacgacgucuaccgcgacgaggcccugaacaaccgguuccagaucaagggcguggagcucaaguccggguacaaggacuggauccuguggaucagcuucgcgaucuccugcuuccugcucugcgucgugcugcugggcuucaucaugugggccugccagaaggggaacauccgcugcaacaucugcaucuga

SEQ ID NO: 70108 - RNA, 1701 nt, Artificial Sequence; identical to SEQ ID NO: 61923
  derived and/or modified sequence opt1 from hemagglutinin__InfluenzaA__AFM72021

SEQ ID NO: 70109 - RNA, 1701 nt, Artificial Sequence
  derived and/or modified sequence opt1 from hemagglutinin__InfluenzaA__AFM72032
augaagaccaucaucgcccugagcuacauguucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccuacacgugcaagcgcgggagcaacaacuccuucuucagccggcugaacuggcucuacgaguccgagagcaaguaccccgugcugaacgucaccaugcccaacaacggcaaguucgacaagcuguacaucuggggcauccaccaccccuccaccgacaaggagcagaccaaccucuacauccgcgccagcgggcgggugaccgugagcacgaagcgcucccagcagaccgucaucccgaacaucggcagccggcccugggugcgcgggcuguccagccggaucuccaucuacuggaccaucgugaagcccggcgacauccugcucaucaacagcaccggcaaccugaucgcgccccgcggguacuucaagauccggacgggcaaguccagcaucaugcgcuccgacgccccgaucgggaccugcagcuccgagugcaucacccccaacggcagcauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacuccgagggcaccgggcaggcggccgaccucaagagcacgcaggccgccaucgaccagaucaacggcaagcugaaccgggugaucgagaagaccaacgagaaguuccaccagaucgagaaggaguucuccgagguggaggggcgcauccaggaccucgagaaguacgucgaggacaccaagaucgaccuguggagcuacaacgccgagcugcucguggcgcuggagaaccagcacaccaucgaccugacggacuccgagaugaacaagcuguucgagaagacccggaagcagcugcgcgagaacgccgaggacaugggcaacgggugcuucaagaucuaccacaagugcgacaacgccugcaucggcagcauccgcaacggcaccuacgaccacgacguguaccgggacgaggcccugaacaaccgcuuccagaucaagggggucgagcucaaguccggcuacaaggacuggauccuguggaucagcuucgccaucagcugcuuccugcucugcgugguccugcugggguucaucaugugggcgugccagaagggcaacauccggugcaacaucugcaucuga

SEQ ID NO: 70110 - RNA, 1701 nt, Artificial Sequence
  derived and/or modified sequence opt1 from hemagglutinin__InfluenzaA__AFM72043
augaagaccaucaucgcccugagcuacauguucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccagcacgugcaagcgcggguccaacaacagcuucuucucccggcugaacuggcucuacgagagcgaguccaaguaccccgugcugaacgucaccaugcccaacaacggcaaguucgacaagcuguacaucuggggcauccaccaccccagcaccgacaaggagcagaccaaccucuacauccgcgccagcgggcgggugaccguguccacgaagcgcagccagcagaccgucaucccgaacaucggcucccggcccugggugcgcgggcugagcucccggaucagcaucuacuggaccaucgugaagcccggcgacauccugcucaucaacuccaccggcaaccugaucgcgccccgcggguacuucaagauccggacgggcaagagcuccaucaugcgcagcgacgccccgaucgggaccugcuccagcgagugcaucacccccaacggcuccauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacagcgagggcaccgggcaggcggccgaccugaaguccacgcaggccgccaucgaccagaucaacggcaagcugaaccgggugaucgagaagaccaacgagaaguuccaccagaucgagaaggaguucagcgagguggaggggcgcauccaggaccucgagaaguacgucgaggacaccaagaucgaccugugguccuacaacgccgagcugcucguggcgcuggagaaccagcacaccaucgaccugacggacagcgagaugaacaagcuguucgagaagacccggaagcagcuccgcgagaacgccgaggacaugggcaacgggugcuucaagaucuaccacaagugcgacaacgccugcaucggcuccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcucugcgugguccugcugggguucaucaugugggcgugccagaagggcaacauccggugcaacaucugcaucuga

SEQ ID NO: 70111 - RNA, 1701 nt, Artificial Sequence
  derived and/or modified sequence opt1 from hemagglutinin__InfluenzaA__AFM72054
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaagcacaacgucaccaagggggugacggccgccugcucccacaagggcaagagcuccuucuaccgcaaccuccuguggcugaccgagaagaacgggagcuaccccaaccucuccaagagcuacgugaacaacaaggagaaggagguccuggugcuguggggcgugcaccaccccagcaacaucgaggaccagaagaccaucuaccggaaggagaacgcguacgucuccguggugagcucccacuacaaccgccgguucacccccgagaucgccaagcgcccgaagguccggaaccaggaggggcgcaucaacuacuacuggacgcuccuggagcccggcgacaccaucaucuucgaggccaacggcaaccugaucgcccccugguacgccuucgcgcucagccggggguucggcuccgggaucaucaccagcaacgccuccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgcgggcuucaucgagggcggcuggaccggcaugaucgacgggugguacggcuaccaccaccagaacgagcagggguccggcuacgccgccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgcggagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgucaagaacgggaccuacgacuacccgaaguacuccgaggagagcaagcucaaccgcgagaagaucgacggcgugaagcuggagagcauggggguguaccagauccuggccaucuacuccaccgucgccagcucccucgugcugcuggugagccucggcgccaucuccuucuggaugugcagcaacggcucccugcagugccggaucugcaucuga

SEQ ID NO: 70112 - RNA, 1701 nt, Artificial Sequence; identical to SEQ ID NO: 70111
  derived and/or modified sequence opt1 from hemagglutinin__InfluenzaA__AFM72065

SEQ ID NO: 70113 - RNA, 1701 nt, Artificial Sequence
  derived and/or modified sequence opt1 from hemagglutinin__InfluenzaA__AFM72087
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgagccugcggucccucguggccagcuccggcacgcuggaguucaucaacgagggguucaacuggaccggcgucacccagagcgggggcuccuacacgugcaagcgcgggagcgugaacuccuucuucagccggcugaacuggcucuacgaguccgaguacaaguaccccgcccugaacgugaccaugcccaacaacggcaaguucgacaagcuguacaucuggggcguccaccaccccagcaccgagaaggagcagaccaaccucuacgugcgcgccuccgggcgggugaccgucagcacgaagcgcagccagcagaccgugaucccgaacaucggcuccagccccugggugcgggggcuguccagccgcaucuccaucuacuggaccaucgucaagcccggcgacauccugcucaucaacagcaccggcaaccugaucgcgccccggggguacuucaagauccgcacgggcaaguccagcaucaugcgguccgacgccccgaucgggaccugcagcuccgagugcaucacccccaacggcagcauccccaacgacaagcccuuccagaacgugaacaagaucaccuacggggccugcccgcgcuacgugaagcagaacacgcugaagcucgccaccggcaugcggaacguccccgagaagcagacccgcggcaucuucggggccaucgcgggcuucaucgagaacgggugggagggcaugguggacgggugguacggcuuccggcaccagaacuccgagggcaccgggcaggccgccgaccugaaguccacgcaggccgccaucgaccagaucaacggcaagcugaaccgccucaucgagaagaccaacgagaaguuccaccagaucgagaaggaguucuccgagguggaggggcggauccaggaccuggagaaguacgucgaggacaccaagaucgaccuguggagcuacaacgcggagcuccugguggcccuggagaaccaguacaccaucgaccucacggacuccgagaugaacaagcuguucgagaagacccgcaagcagcugcgggagaacgccgaggacaugggcaacgggugcuucaagaucuaccacaagugcgacaacgccugcaucggcagcauccgcaacggcaccuacgaccacgacguguaccgcgacgaggcccucaacaaccgguuccagaucaagggggucgagcugaaguccggcuacaaggacuggauccuguggaucagcuucgcgaucagcugcuuccuccugugcgugguccugcucggguucaucaugugggccugccagaagggcaacauccgcugcaacaucugcaucuga

SEQ ID NO: 70114 - RNA, 1701 nt, Artificial Sequence
  derived and/or modified sequence opt1 from hemagglutinin__InfluenzaA__AFM72098
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcucuacaaguccgaguacaaguaccccgcccugaacgucaccaugcccaacaacgggaaguucgacaagcuguacaucuggggcgugcaccaccccgugacggaccgcgagcagaccaaccucuacguccgggcgagcggccgcgugaccguguccaccaagcggagccagcagacggucaucccgaacaucgggagccgccccugggugcggggccuguccagccgcaucuccaucuacuggaccaucgugaagcccggggacauccugcucaucaacagcaccggcaaccugaucgcgccccggggcuacuucaagauccgcaccgggaaguccagcaucaugcgguccgacgccccgaucggcacgugcagcuccgagugcaucacccccaacgggagcauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgccggguucaucgagaacggcugggaggggauggucgacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaagggcgucgagcugaaguccggguacaaggacuggauccuguggaucagcuucgccaucuccugcuuccuccugugcguggugcugcucggcuucaucaugugggccugccagaaggggaacauccgcugcaacaucugcaucuga

SEQ ID NO: 70115 - RNA, 1701 nt, Artificial Sequence
  derived and/or modified sequence opt1 from hemagglutinin__InfluenzaA__AFM72109
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcuccacaaguccgaguacaaguaccccgcccugaacgucaccaugcccaacaacgggaaguucgacaagcuguacaucuggggcgugcaccaccccaucacggaccgcgagcagaccaaccucuacgugcgggcgagcggccgcgucaccguguccaccaagcggagccagcagacggugaucccgaacaucgggagccgccccuggguccggggccuguccagccgcaucuccaucuacuggaccaucgugaagcccggggacauccugcucaucaacagcaccggcaaccugaucgcgccccggggcuacuucaagauccgcaccgggaaguccagcaucaugcgguccgacgccccgaucggcacgugcagcuccgagugcaucacccccaacgggagcauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacuccgagggcaccggccaggccgccgaccugaaguccacccaggccgcgaucgaccagaucaacgggaagcugaaccgccucaucgagaagacgaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucaccgacuccgagaugaacaagcuguucgagaagacgcgccgccagcugcgggagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 70116 - RNA, 1701 nt, Artificial Sequence
  derived and/or modified sequence opt1 from hemagglutinin__InfluenzaA__AFM72120
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcuccacgaguccgaguacaaguaccccgcccugaacgucaccaugcccaacaacgggaaguucgacaagcuguacaucuggggcgugcaccaccccaucacggaccgcgagcagaccaaccucuacgugcgggcgagcggccgcgucaccguguccaccaagcggagccagcagacggugaucccgaacaucggguuccgccccuggguccggggccugagcucccgcaucagcaucuacuggaccaucgugaagcccggggacauccugcucaucaacuccaccggcaaccugaucgcgccccggggcuacuucaagauccgcaacggcaagagcuccaucaugcggagcgacgccccgaucgggaccugcuccagcgagugcaucacgcccaacggguccauccccaacgacaagcccuuccagaacgugaacaagaucaccuacggcgccugcccgcgcuacgucaagcagaacacccugaagcucgccaccgggaugcggaacgugcccgagaagcagacgcgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgcgagaacgccgaggacauggggaacggcugcuucaagaucuaccacaagugcgacaacgccugcaucggguccauccggaacggcacguacgaccacgacgucuaccgcgacgaggcgcucaacaaccgguuccagaucaagggcguggagcugaaguccggguacaaggacuggauccuguggaucuccuucgccaucagcugcuuccuccugugcgucgugcugcucggcuucaucaugugggccugccagaaggggaacauccgcugcaacaucugcaucuga

SEQ ID NO: 70117 - RNA, 1701 nt, Artificial Sequence
  derived and/or modified sequence opt1 from hemagglutinin__InfluenzaA__AFM72131
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaaggacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaacgggguggcccagagcggcgaguccuacgccugcaagcgcgggagcgugaaguccuucuucagccggcucaacuggcugcacgaguccgaguacaaguaccccgcgcugaacgucaccaugcccaacaacggcaaguucgacaagcucuacaucuggggcgugcaccaccccagcaccgaccgcgagcagaccaagcuguacgugcgggccuccgggcgcgucacggugagcaccaagcggagccagcagaccgugaucccgaacaucggcucccgccccuggguccgggggcugagcucccgcaucagcaucuacuggaccaucgugaagcccggcgacauccuccugaucaacuccacggggaaccugaucgcgccccggggcuacuucaagauccgcaccggcaagagcuccaucaugcggagcgacgccccgaucgggaccugcuccagcgagugcaucacccccaacggcuccauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 70118 - RNA, 1701 nt, Artificial Sequence
  derived and/or modified sequence opt1 from hemagglutinin__InfluenzaA__AFM72142
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaucaacgaggacuucaacuggaccgggguggcccaggacggcggguccuacgccugcaagcgcggcagcgugaacuccuucuucagccggcugaacuggcuccacaagcuggaguacaaguaccccgcgcugaacgucaccaugcccaacaacgggaaguucgacaagcucuacaucuggggcgugcaccaccccuccaccgaccgcgaccagacgagccuguacgugcgggccuccggccgcgucaccgugagcaccaagcggagccagcagaccgugaucccgaacaucgggucccgccccuggguccggggccagagcucccgcaucagcaucuacuggacgaucgugaagcccggggacauccugcucaucaacuccaccggcaaccugaucgcgccccggggcuacuucaagauccgcaacggcaagagcuccaucaugcggagcgacgccccgaucgggaacugcuccagcgagugcaucacccccaacggguccauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccugaaguccacgcaggcggccaucgaccagaucaacgggaagcugaaccggcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagcgcacccggaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 70119 - RNA, 1701 nt, Artificial Sequence
  derived and/or modified sequence opt1 from hemagglutinin__InfluenzaA__AFM72153
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcggcagcccccaccggauccuggacgggaagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaucaacgaggacuucaacuggaccggcguggcccaggacgggggcagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugacgccgaacaucggcucccggcccuggguccgcgggcagagcucccggaucggcaucuacuggaccaucgugaagcccggcgacauccuccugaucaacagcaccgggaaccugaucgcgccccgcggcuacuucaagauccggaacgggaaguccagcaucaugcgcuccgacgccccgaucggcaacugcagcuccgagugcaucacccccaacgggagcauccccaacgacaagcccuuccagaacgugaaccggaucacguacggcgccugcccgcgcuacgucaagcagaacacccucaagcuggccaccggcaugcggaacgugcccgagaagcagacccgcgggaucuucggcgccaucgccggguucaucgagaacggcugggaggggaugguggacggcugguacggcuuccggcaccagaacuccgaggggacgggccaggccgccgaccugaaguccacccaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucggcagcauccggaacgggaccuacgaccacgacgucuaccgcgacgaggcccugaacaaccgguuccagaucaagggcguggagcugaaguccggguacaaggacuggauccucuggaucagcuucgccaucuccugcuuccugcugugcgucgugcuccugggcuucaucaugugggccugccagaagggcaacauccgcugcaacaucugcaucuga

SEQ ID NO: 70120 - RNA, 1701 nt, Artificial Sequence
  derived and/or modified sequence opt1 from hemagglutinin__InfluenzaA__AFM72164
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaucaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccaccgacagcgaccagacgucccuguacgugcgcgccagcgggcgggucaccguguccaccaagcgcagccagcagaccgugauccccgacaucggcuaccggcccuggguccgcgggcagagcucccggaucagcauccacuggacgaucgugaagcccggcgacauccuccugaucaacuccaccgggaaccugaucgccccgcgcggcuacuucaagauccggaacggcaagagcuccaucaugcgcagcgacgcccccaucgggaacugcuccagcgagugcaucacccccaacggcuccauccccaacgacaagccguuccagaacgugaaccggaucaccuacggggccugcccccgcuacgucaagcagaacacgcucaagcuggcgaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccugaaguccacgcaggcggccaucgaccagaucaacggcaagcucaaccgccuggucgagaagaccaacgagaaguuccaccagaucgagaaggaguucagcgagguggaggggcggauccaggaccuggagaaguacguggaggacaccaagaucgaccucugguccuacaacgccgagcugcuggucgcccucgagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcugugcguggugcuccugggguucaucaugugggccugccagaagggcaacauccggugcaacaucugcaucuga

SEQ ID NO: 70121 - RNA, 1701 nt, Artificial Sequence
  derived and/or modified sequence opt1 from hemagglutinin__InfluenzaA__AFM72175
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaucaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccaccgacagcgaccagacgaaccuguacgugcgcgccuccgggcgggucaccgugagcaccaagcgcucccagcagaccgugauccccgacaucggcuaccggcccuggguccgcgggcagagcagccggaucuccauccacuggacgaucgugaagcccggcgacauccuccugaucaacagcaccgggaaccugaucgccccgcgcggcuacuucaagauccggaacggcaaguccagcaucaugcgcuccgacgcccccaucgggaacugcagcuccgagugcaucacccccaacggcagcauccccaacgacaagccguuccagaacgugaaccggaucaccuacggggccugcccccgcuacgucaagcagaacacgcucaagcuggcgaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccuggucgagaagaccaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugacggacuccgagaugaacaagcuguucgagcgcacccgcaagcagcuccgggagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggugcuccugggguucaucaugugggccugccagaagggcaacauccggugcaacaucugcaucuga

SEQ ID NO: 70122 - RNA, 1701 nt, Artificial Sequence
  derived and/or modified sequence opt1 from hemagglutinin__InfluenzaA__AFM72197
augaagaccaucaucgcccugagcuacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcgugaaguccuucuucagccgccugaacuggcuccacaagcuggaguacaaguaccccgcgcugaacgucaccaugcccaacaacgacaaguucgacaagcucuacaucuggggcgugcaccaccccaucacggacuccgagcagaccagccuguacgugcaggccuccgggcgggucaccgugagcaccaagcgcagccagcagacggugaucccgaacaucggguaccggcccuggguccgcggcguguccagccggaucuccaucuacuggaccaucgugaagcccggcgacauccugcucaucaacagcaccgggaaccugaucgcgccccgcggcuacuucaagauccgguccgggaaguccuccaucaugcgcagcgacgccccgaucggcaacugcaacuccgagugcaucacccccaacggcagcauccccaacgacaagcccuuccagaacgucaaccggaucacguacggggccugcccgcgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccgcaagcagcugcgggagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggugcugcucggcuucaucaugugggccugccagaagggcaacaucaagugcaacaucugcaucuga

SEQ ID NO: 70123 - RNA, 1701 nt, Artificial Sequence
  derived and/or modified sequence opt1 from hemagglutinin__InfluenzaA__AFM72208
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaucaacagcuucuucucccggcucaacuggcugcaccagcugaaguaccgcuaccccgcgcucaacgugaccaugcccaacaacgacaaguucgacaagcuguacaucuggggcguccaccaccccagcacggacuccgaccagaccagccuguacacccaggccagcgggcgggugaccguguccacgaagcgcagccagcagaccgucaucccgaacaucgggucccggcccugggugcgcggcaucagcucccggaucagcaucuacuggaccaucgugaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacgcccaacggcuccauccccaacgacaagcccuuccagaacgucaaccggaucaccuacggggccugcccgcgcuacgugaagcagaacacccucaagcuggccaccggcaugcggaacgugcccgagaagcagacgcgcgggaucuucggcgccaucgccggguucaucgagaacggcugggagggcaugauggacgggugguacggcuuccggcaccagaacagcgaggggaccggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacacgaagaucgaccucugguccuacaacgccgagcugcugguggcccucgagaaccagcacaccaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 70124 - RNA, 1701 nt, Artificial Sequence
  derived and/or modified sequence opt1 from hemagglutinin__InfluenzaA__AFM72219
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaucaacagcuucuucucccggcucaacuggcugcaccagcugaaguaccgcuaccccgcgcucaacgugaccaugcccaacaacgacaaguucgacaagcuguacaucuggggcguccaccaccccagcacggacuccgaccagaccagccuguacacccaggccagcgggcgggugaccguguccacgaagcgcagccagcagaccgucaucccgaacaucgggucccggcccugggugcgcggcaucagcucccggaucagcaucuacuggaccaucgugaagcccggcgacauccuccugaucaaguccaccgggaaccugaucgcgccccgcggcuacuucaagauccggagcgggaaguccagcaucaugcgcuccgacgccccgaucggcaagugcaacagcgagugcaucacgcccaacggcuccauccccaacgacaagcccuuccagaacgucaaccggaucaccuacggggccugcccgcgcuacgugaagcagaacacccucaagcuggccaccggcaugcggaacgugcccgagaagcagacgcgcgggaucuucggcgccaucgccggguucaucgagaacggcugggagggcaugauggacgggugguacggcuuccggcaccagaacagcgaggggaccggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacacgaagaucgaccucugguccuacaacgccgagcugcugguggcccucgagaaccagcacaccaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 70125 - RNA, 1698 nt, Artificial Sequence
  derived and/or modified sequence opt1 from hemagglutinin__InfluenzaA__AFM72230
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagaaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 70126 - RNA, 1701 nt, Artificial Sequence
  derived and/or modified sequence opt1 from hemagglutinin__InfluenzaA__AFM72246
augaagaccaucaucgcccugagcuacauccucugccugguguucgcccagaagcugcccggcaacgacaacuccaccgcgacgcucugccuggggcaccacgccgucagcaacggcacccuggugaagaccaucaccaacgaccagaucgaggugacgaacgccaccgagcucguccaguccagcuccaccgggcgcaucugcgacagcccgcaccagauccuggacggcgagaacugcacccugaucgacgcccuccugggggacccccacugcgacggcuuccagaacaaggagugggaccuguucguggagcgguccaaggccuacagcaacugcuaccccuacgacgugcccgacuacgcgucccuccgcagccuggucgccuccagcggcacgcuggaguucaacaacgaguccuucaacuggaccgggguggcccagaacggcaccagcuccgccugcaagcggcgcagcaacaaguccuucuucagccggcucaacuggcugcaccagcugaaguacaaguacccggcgcucaacgugaccaugcccaacaacgagaaguucgacaagcuguacaucuggggcguccaccaccccuccacggacagcgaccagaucagcaucuacgcccaggccuccgggcgcgugaccgugagcaccaagcggucccagcagaccgucauccccaacaucgggagcuccccgugggugcgcggcgugagcucccggaucagcaucuacuggacgaucgucaagcccggcgacauccugcucaucaacuccaccgggaaccugaucgcgccccgcggcuacuucaagauccggagcgggaaguccagcaucaugcgcuccgacgcccccaucggcaagugcaacagcgagugcaucaccccgaacggcuccauccccaacgacaagcccuuccagaacgugaaccggaucaccuacggggccugcccccgcuacgugaagcagaacacgcugaagcucgccaccggcaugcggaacgucccggagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagcgcaccaagaagcagcugcgggagaacgcggaggacaugggcaacgggugcuucaagaucuaccacaagugcgacaacgccugcaucggcagcauccgcaacgggaccuacgaccacgacguguaccgcgacgaggcccucaacaaccgguuccagaucaagggcgucgagcugaaguccggguacaaggacuggauccuguggaucagcuucgccaucuccugcuuccuccugugcgugguccugcucggcuucaucaugugggccugccagaagggcaacauccgcugcaacaucugcaucuga

SEQ ID NO: 70127 - RNA, 1701 nt, Artificial Sequence
  derived and/or modified sequence opt1 from hemagglutinin__InfluenzaA__AFM72257
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaacuacaaguaccccgcgcucaacgucacgaugcccaacaacgagaaguucgacaagcuguacaucuggggcgugcaccaccccagcaccgacuccgaccagaucagcaucuacgcccaggccagcgggcgcgugaccgucuccaccaagcggagccagcagacggugaucccgaacaucggcucccgccccugggugcgcggggucagcuccggcaucagcaucuacuggaccaucgugaagcccggcgacauccugcucaucaacuccaccgggaaccugaucgcgccccggggcuacuucaagauccggagcgggaaguccagcaucaugcgcuccaacgccccgaucggcaagugcaacagcgagugcaucacccccaacggcuccauccccaacgacaagcccuuccagaacgugaaccggaucacguacggggccugcccgcgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaagggcaacauccggugcaacaucugcaucuga

SEQ ID NO: 70128 - RNA, 1701 nt, Artificial Sequence
  derived and/or modified sequence opt1 from hemagglutinin__InfluenzaA__AFM72268
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaacuacaaguaccccgcgcucaacgucacgaugcccaacaacgagaaguucgacaagcuguacaucuggggcgugcaccaccccaacaccgacagcgaccagaucuccaucuacgcccaggccagcgggcgcgugaccgucagcaccaagcggucccagcagacggugaucccgaacaucggcagccgccccugggugcgcggggucuccagcggcaucuccaucuacuggaccaucgugaagcccggcgacauccugcucaucaacagcaccgggaaccugaucgcgccccggggcuacuucaagauccgguccgggaaguccuccaucaugcgcagcaacgccccgaucggcaagugcaacuccgagugcaucacccccaacggcagcauccccaacgacaagcccuuccagaacgugaaccggaucacguacggggccugcccgcgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcacccggaagcagcugcgcgagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggguacaaggacuggauccuguggaucagcuucgccaucagcugcuuccuccugugcgucgugcugcucggcuucaucaugugggccugccagaagggcaacauccggugcaacaucugcaucuga

SEQ ID NO: 70129 - RNA, 1701 nt, Artificial Sequence
  derived and/or modified sequence opt1 from hemagglutinin__InfluenzaA__AFM72279
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagcaucuacgcccaggccagcgggcgcgugaccgucuccaccaagcggagccagcagacggugaucccgaacaucggcuccaagcacugggugcgcggggucagcucccggaucagcaucuacuggaccaucgugaagcccggcgacauccugcucaucaacuccaccggcaaccugaucgcgccccgcggguacuucaagauccggagcggcaaguccagcaucaugcgcuccaacgcccccaucgggaagugcaacagcgagugcaucaccccgaacggcuccauccccaacgacaagcccuuccagaacgugaaccggaucacguacggcgccugcccccgcuacgucaagcagaacacccugaagcucgccaccgggaugcggaacgugccggagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcugaaccgccucaucgagaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggguucaucaugugggccugccagaagggcaacauccggugcaacaucugcaucuga

SEQ ID NO: 70130 - RNA, 1701 nt, Artificial Sequence
  derived and/or modified sequence opt1 from hemagglutinin__InfluenzaA__AFM72290
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaggacaaguaccccgcgcucaacgucacgaugcccaacaacgagaaguucgacaagcuguacaucuggggcgugcaccaccccagcaccgacuccgaccagaucagcaucuacgcccaggccagcgggcgcgugaccgucuccaccaagcggagccagcagacggugaucccgaacaucggcuccaagcacugggugcgcggggucagcucccggaucagcaucuacuggaccaucgugaagcccggcgacauccugcucaucaacuccaccggcaaccugaucgcgccccgcggguacuucaagauccggagcggcaaguccagcaucaugcgcuccaacgcccccaucgggaagugcaacagcgagugcaucaccccgaacggcuccauccccaacgacaagcccuuccagaacgugaaccggaucacguacggcgccugcccccgcuacgucaagcagaacacccugaagcucgccaccgggaugcggaacgugccggagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcugaaccgccucaucgagaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgucgugcugcucggguucaucaugugggccugccagaagggcaacauccggugcaacaucugcaucuga

SEQ ID NO: 70131 - RNA, 1701 nt, Artificial Sequence
  derived and/or modified sequence opt1 from hemagglutinin__InfluenzaA__AFM72301
augaagaccaucaucgcccugagcuacauccucugccugguguucucccagaagcugcccggcaacgacaacagcaccgccacgcucugccuggggcaccacgcggucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggagccucgucgcguccagcgggacgcuggaguucaacaacgaguccuucaacugggccggcgugacccagaacgggaccagcuccgccugcaagcgccggagcaacaaguccuucuucagccgccugaacuggcucacccagcugaaguacaaguaccccgcccugaacgugacgaugcccaacaacgagaaguucgacaagcucuacaucuggggcguccaccaccccgugaccgacuccgaccagaucagccuguacgcgcaggccagcgggcggaucaccguguccaccaagcgcagccagcagacggucaucccgaacaucggcuaccggccccgcgugcgggacaucuccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacccccaacggcagcauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgagagcauccgcaacgggaccuacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaagggcaacauccggugcaacaucugcaucuga

SEQ ID NO: 70132 - RNA, 1701 nt, Artificial Sequence
  derived and/or modified sequence opt1 from hemagglutinin__InfluenzaA__AFM72312
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgugaccgacagcgaccagaucaaccuguacgcgcaggccuccgggcggaucaccgugagcacgaagcgcagccagcagaccgucaucccgaacaucggcuaccggccccgcgugcgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 70133 - RNA, 1701 nt, Artificial Sequence
  derived and/or modified sequence opt1 from hemagglutinin__InfluenzaA__AFM72323
augaaggccaucaucgcccugagcuacauccucugccugguguucgcgcagaagcugcccggcaacgacaacuccaccgccacccucugccuggggcaccacgccgucccgaacggcacgaucgugaagaccaucaccaacgaccagaucgaggugaccaacgccacggagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcguacuccaacugcuaccccuacgacgugccggacuacgccagccugcggucccucgucgccagcuccgggacccuggaguucaacaacgagagcuucaacuggacgggcgugacccagaacgggaccuccagcgccugcaagcgccgguccaacaagagcuucuucucccgccugaacuggcucacccaccugaaguacaaguaccccgcgcugaacgugacgaugcccaacaacgagaaguucgacaagcucuacaucuggggcguccaccaccccgugaccgacagcgaccagaucaaccuguacgcccaggccuccgggcggaucaccgugagcaccaagcgcagccagcagacggucaucccgaacaucggcuaccggccccgcgugcgggacaaccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggacgggccaggccgcggaccugaaguccacccaggccgccaucaaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 70134 - RNA, 1701 nt, Artificial Sequence
  derived and/or modified sequence opt1 from hemagglutinin__InfluenzaA__AFM72334
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccugcaccccgggaccuacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccuccugaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 70135 - RNA, 1701 nt, Artificial Sequence
  derived and/or modified sequence opt1 from hemagglutinin__InfluenzaA__AFM72345
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgugaccgacagcgaccagaucucccuguacacccaggcgagcgggcggaucacggugagcaccaagcgcucccagcagaccgucaucccgaacaucggcuuccggccccgcgugcgggacaucagcucccgcaucagcaucuacuggaccaucgugaagcccggcgacauccugcucaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacagcgaggggaccggccaggccgccgaccugaaguccacccaggccgcgaucaaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacauggggaacggcugcuucaagaucuaccacaagugcgacaacgccugcaucggguccauccgcaacggcaccuacgaccacgacguguaccgggacgaggcgcucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 70136 - RNA, 1701 nt, Artificial Sequence
  derived and/or modified sequence opt1 from hemagglutinin__InfluenzaA__AFM72356
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucaaccuguacgugcaggcgagcggccggaucaccguguccacgaagcgcagccagcagaccgucaucccgaacaucggcagccggccccgcgugcgggacgugcccucccgcaucagcaucuacuggaccaucgucaagcccggggacauccugcucaucuccagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgccaccgggaugcgcaacguccccgagaagcagacgcggggcaucuucggggcgaucgccggcuucaucgagaacggcugggaggggaugguggacggcugguacggguuccgccaccagaacuccgagggcaccgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 70137 - RNA, 1701 nt, Artificial Sequence
  derived and/or modified sequence opt1 from hemagglutinin__InfluenzaA__AFM72367
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgugaccgacaacgaccagaucaaccuguacgcgcaggccagcgggcggaucaccguguccacgaagcgcagccagcagaccgucaucccgaacaucggcagccggccccgcgugcgggacgugcccucccgcaucagcaucuacuggaccaucgucaagcccggcgacauccugcucaucuccagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70138 - RNA, 1701 nt, Artificial Sequence
  derived and/or modified sequence opt1 from hemagglutinin__InfluenzaA__AFM72378
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcagcugaacuucaaguaccccgcccugaacgugaccaugcccaacaacgagcaguucgacaagcucuacaucuggggcguccaccaccccgugaccgacaaggaccagaucuuccuguacgcgcaggccagcgggcggaucaccguguccacgaagcgcagccagcaggccgucaucccgaacaucggguaccggccccgcgugcggaacauccccagccgcguguccaucuacuggaccaucgucaagcccggcgacauccugcucaucaacagcaccggcaaccugaucgccccgcggggguacuucaagauccgcuccggcaagagcuccaucaugcggagcgacgcccccaucgggaagugcaacuccgcgugcaucacccccaacggcagcauccccaacgacaagccguuccagaacgugaaccgcaucacguacggcgccugcccccgguacgugaagcagaacacccugaagcucgccaccgggaugcgcaacguccccgagaagcagacccggggcaucuucggggccaucgccggcuucaucgagaacgggugggagggcaugguggacggcugguacggguuccgccaccagaacuccgagggccgggggcaggcggccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggcgcugcucggcuucaucaugugggccugccagaagggcaacauccggugcaacaucugcaucuga

SEQ ID NO: 70139 - RNA, 1701 nt, Artificial Sequence
  derived and/or modified sequence opt1 from hemagglutinin__InfluenzaA__AFM72389
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgugaccgacaaggaccagaucuuccuguacgcgcaggccagcgggcggaucaccguguccacgaagcgcagccagcaggccgucaucccgaacaucggguaccggccccgcgugcggaacaaccccagccgcguguccaucuacuggaccaucgucaagcccggcgacauccugcucaucaacagcaccggcaaccugaucgccccgcggggguacuucaagauccgcuccggcaagagcuccaucaugcggagcgacgcccccaucgggaagugcaacuccgcgugcaucacccccaacggcagcauccccaacgacaagccguuccagaacgugaaccgcaucacguacggcgccugcccccgguacgugaagcagaacacccugaagcucgccaccgggaugcgcaacguccccgagaagcagacccggggcaucuucggggccaucgccggcuucaucgagaacgggugggagggcaugguggacggcugguacggguuccgccaccagaacuccgagggccgggggcaggcggccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggcgcugcucggcuucaucaugugggccugccagaagggcaacauccggugcaacaucugcaucuga

SEQ ID NO: 70140 - RNA, 1701 nt, Artificial Sequence
  derived and/or modified sequence opt1 from hemagglutinin__InfluenzaA__AFM72400
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcaagcgcggguccaacaacagcuucuucucccggcugaacuggcucacccacagcaaguucaaguaccccgcgcugaacgugacgaugcccaacaacgaggaguucgacaagcuguacaucuggggcguccuccaccccgggaccgacaacgaccagaucuuccuguacgcccaggccuccggccgcaucaccgugagcaccaagcggagccagcagacggugaucccgaacaucggcucccgcccccggguccgcaacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacccccaacgggagcauccccaacgacaagccguuccagaacgugaaccggaucacguacggcgcgugcccccgcuacgucaagcagaacacccugaagcucgccaccgggaugcggaacgugcccgagaagcagacccgcggcaucuucggggccaucgccggcuucaucgagaacggcugggaggggaugguggacggcugguacggguuccggcaccagaacuccgagggcaucgggcaggccgcggaccugaaguccacgcaggccgccaucgaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcagcauccggaacgggaccuacgaccacgacgucuaccgcgacgaggcccucaacaaccgcuuccagaucaagggcguggagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 70141 - RNA, 1701 nt, Artificial Sequence
  derived and/or modified sequence opt1 from hemagglutinin__InfluenzaA__AFM72411
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcaagcgcggguccaacaacagcuucuucucccggcugaacuggcucacccagagcaaguucaaguaccccgcgcugaacgugacgaugcccaacaacgaggaguucgacaagcuguacaucuggggcguccaccaccccgugaccgacaacgaccagaucuuccucuacgcccaggccuccgggcgcaucaccgugagcaccaagcggagccagcagacggucaucccgaacaucggcucccgcccccgggugcgcaacauccccagccggaucuccaucuacuggaccaucgugaagcccggcgacauccugcugaucaacagcaccgggaaccucaucgccccgcgcggcuacuucaagauccgguccgggaaguccuccaucaugcgcagcgacgcccccaucggcaagugcaacuccgagugcaucacccccaacggcagcauccccaacgacaagccguuccagaacgucaaccggaucacguacggggcgugcccccgcuacgugaagcagaacacccugaagcuggccaccggcaugcggaacgugcccgagaagcagacccgcgggaucuucggcgccaucgccggguucaucgagaacggcugggagggcauggucgacgggugguacggcuuccggcaccagaacuccgaggggaucggccaggccgcggaccucaagagcacgcaggccgccaucgaccagaucaacgggaagcugaaccgccugaucggcaagaccaacgagaaguuccaccagaucgagaaggaguucuccgagguggagggccggauccaggacuucgagaaguacguggaggacaccaagaucgaccucuggagcuacaacgccgagcugcuggucgcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacguguaccgcgacgaggcccugaacaaccgcuuccagaucaaggggguggagcugaaguccggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 70142 - RNA, 1701 nt, Artificial Sequence
  derived and/or modified sequence opt1 from hemagglutinin__InfluenzaA__AFM72422
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaacgaccagaucuuccuguacgcgcaggccagcgggcggaucaccguguccacgaagcgcagccagcagaccgucaucccgaacaucggguuccggccccgcgugcggaacauccccagccgcaucuccaucuacuggaccaucgugaagcccggcgacauccugcucaucaacagcaccggcaaccugaucgccccgcggggguacuucaagauccgcuccggcaagagcuccaucaugcggagcgacgcccccaucgggaagugcaacuccgagugcaucacgcccaacggcagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 70143 - RNA, 1701 nt, Artificial Sequence
  derived and/or modified sequence opt1 from hemagglutinin__InfluenzaA__AFM72433
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaacgaccagaucuuccuguacgcgcaggccagcgggcggaucaccguguccacgaagcgcagccagcagaccgucaucccgaacaucggguuccggccccgcgugcggaacaaccccagccgcaucuccaucuacuggaccaucgugaagcccggcgacauccugcucaucaacagcaccggcaaccugaucgccccgcggggguacuucaagauccgcuccggcaagagcuccaucaugcggagcgacgcccccaucgggaagugcaacuccgagugcaucacgcccaacggcagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 70144 - RNA, 1701 nt, Artificial Sequence
  derived and/or modified sequence opt1 from hemagglutinin__InfluenzaA__AFM72444
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaacgaccagauccugcuguacgcgcaggccagcgggcggaucaccguguccacgaagcgcagccagcagaccgucaucccgaacaucggguuccggccccgcgugcggaacaaccccagccgcaucuccaucuacuggaccaucgugaagcccggcgacauccuccugaucaacagcaccggcaaccugaucgccccgcggggguacuucaagauccgcuccggcaagagcuccaucaugcggagcgacgcccccaucgggaagugcaacuccgagugcaucacgcccaacggcagcauccccaacgacaagccguuccagaacgucaaccgcaucaccuacggcgccugcccccgguacgugaagcagaacacccucaagcuggcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcucaaccggcugaucgggaagaccaacgagaaguuccaccagaucgagaaggaguucuccgagguggagggccgcauccaggaccuggagaaguacgccgaggacaccaagaucgaccucuggagcuacaacgccgagcugcugguggcccucgagaaccagcacacgaucgaccugaccgacuccgagaugaacaagcuguucgagaagaccaagaagcagcuccgggagaacgcggaggacaugggcaacgggugcuucaagaucuaccacaagugcgacaacgccugcaucggcagcauccgcaacgggaccuacgaccacgacgucuaccgcgacgaggcccugaacaaccgguuccagaucaagggcguggagcugaaguccggguacaaggacuggauccucuggaucagcuucgccaucuccugcuuccugcugugcguggcccuccugggcuucaucaugugggcgugccagaagggcaacauccgcugcaacaucugcaucuga

SEQ ID NO: 70145 - RNA, 1701 nt, Artificial Sequence
  derived and/or modified sequence opt1 from hemagglutinin__InfluenzaA__AFM72455
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcagcugaaguucaaguaccccgcccugaacgugaccaugcccaacaacgaggaguucgacaagcucuacaucuggggcguccaccaccccgugaccgacaacgaccagaucuuccuguacgcgcaggccagcgggcggaucaccguguccacgaagcgcagccagcagaccgucaucccgaacaucggguuccggccccgcgugcggaacaaccccagccgcaucuccaucuacuggaccaucgugaagcccggcgacauccugcucaucaacagcaccggcaaccugaucgccccgcggggguacuucaagauccgcuccggcaagagcuccaucaugcggagcgacgcccccaucgggaagugcaacuccgagugcaucacgcccaacggcagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 70146 - RNA, 1701 nt, Artificial Sequence
  derived and/or modified sequence opt1 from hemagglutinin__InfluenzaA__AFM72466
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgugaccgacaaggaccagaucuuccuguacgcgcaggccagcgggcggaucaccguguccacgaagcgcagccagcagaccgucaucccgaacaucggguuccggccccgcgugcggaacaaccccagccgcaucuccaucuacuggaccaucgugaagcccggcgacauccugcucaucaacagcaccggcaaccugaucgccccgcggggguacuucaagauccgcuccggcaagagcuccaucaugcggagcgacgcccccaucgggaagugcaacuccgagugcaucacgcccaacggcagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacgggugggagggcauggucgacggcugguacggguuccgccaccagaacuccgagggcaucgggcaggccgccgaccugaaguccacccaggcggccaucgaccagaucaacggcaagcugaaccggcucaucgggaagaccaacgagaaguuccaccagaucgagaaggaguucuccgagguggagggccgcauccaggaccuggagaaguacgccgaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggcgugccagaagggcaacauccgcugcaacaucugcaucuga

SEQ ID NO: 70147 - RNA, 1701 nt, Artificial Sequence
  derived and/or modified sequence opt1 from hemagglutinin__InfluenzaA__AFM72488
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcagcugaaguucaaguaccccgcccugaacgugaccaugcccaacaacgagaaguucgacaagcucuacaucuggggcguccaccaccccgugaccgacaacgagcagaucuuccuguacgcgcaggccagcgggcggaucaccguguccacgaagcgcagccagcagaccgucaucccgaacaucggcuuccggccccgcgugcggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccaagugcaucacgcccaacggcagcauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 70148 - RNA, 1701 nt, Artificial Sequence
  derived and/or modified sequence opt1 from hemagglutinin__InfluenzaA__AFM72499
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcagcugaaguucaaguaccccgcccugaacgugaccaugcccaacaacgagaaguucgacaagcucuacaucuggggcguccaccaccccgugaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 70149 - RNA, 1698 nt, Artificial Sequence
  derived and/or modified sequence opt1 from hemagglutinin__InfluenzaA__AFM72521
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggcgccucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgggagcagcucuccagcguguccagccuggagcgcuucgagaucuucccgaaggaguccagcuggcccaaccacacggucaccgggguguccgccagcugcucccacaacggcgagagcuccuucuaccggaaccugcucuggcugaccgggaagaacggccuguaccccaaccucagcaaguccuacgccaacaacaaggagaaggaggugcugguccuguggggcgugcaccacccgcccaacaucggcaaccagaaggcccucuaccacaccgagaacgccuacgugagcgucgugagcucccacuacagccgcaaguucacgcccgagaucgccaagcggcccaaggugcgcgaccaggagggccggaucaacuacuacuggacccugcuggagcccggggacaccaucaucuucgaggcgaacggcaaccucaucgccccgcgcuacgccuucgcccugucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcuccggauggucaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcgccggauggagaaccugaacaagaaggucgacgacggcuucaucgacaucuggaccuacaacgccgagcugcucgugcugcuggagaacgagcgcacgcucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggaguccaugggcgucuaccagauccuggccaucuacagcaccguggccagcucccucgugcugcuggucagccucggggccaucuccuucuggaugugcagcaacggcucccugcagugccgcaucugcaucuga

SEQ ID NO: 70150 - RNA, 1698 nt, Artificial Sequence; identical to SEQ ID NO: 70149
  derived and/or modified sequence opt1 from hemagglutinin__InfluenzaA__AFM72532

SEQ ID NO: 70151 - RNA, 1698 nt, Artificial Sequence; identical to SEQ ID NO: 70149
  derived and/or modified sequence opt1 from hemagglutinin__InfluenzaA__AFM72543

SEQ ID NO: 70152 - RNA, 1698 nt, Artificial Sequence
  derived and/or modified sequence opt1 from hemagglutinin__InfluenzaA__AFM72554
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggcgccucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgggagcagcucuccagcguguccagccuggagcgcuucgagaucuucccgaaggaguccagcuggcccaaccacacggucaccgggguguccgccagcugcucccacaacggcgagagcuccuucuaccggaaccugcucuggcugaccgggaagaacggccuguaccccaaccucagcaaguccuacgccaacaacaaggagaaggaggugcugguccuguggggcgugcaccacccgcccaacaucggcaaccagaaggcccucuaccacaccgagaacgccuacgugagcgucgugagcucccacuacagccgcaaguucacgcccgagaucgccaagcggcccaaggugcgcgaccaggagggccggaucaacuacuacuggacccugcuggagcccggggacaccaucaucuucgaggcgaacggcaaccucaucgccccgcgcuacgccuucgcccugucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcuccggauggucaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcgccggauggagaaccugaacaagaaggucgacgacggcuucaucgacaucuggaccuacaacgccgagcugcucgugcugcuggagaacgagcgcacgcucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacgaggugaagcuggaguccaugggcgucuaccagauccuggccaucuacagcaccguggccagcucccucgugcugcuggucagccucggcgccaucuccuucuggaugugcagcaacgggucccugcagugccgcaucugcaucuga

SEQ ID NO: 70153 - RNA, 1701 nt, Artificial Sequence
  derived and/or modified sequence opt1 from hemagglutinin__InfluenzaA__AFM72565
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcauccgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccgggcggaucaccgugagcacgaagcgcagccagcagaccgugauccccaacaucggcucccggccccgcguccggaacauccccagccgcaucuccaucuacuggaccaucgugaagccgggcgacauccugcugaucaacagcaccgggaaccucaucgcgccccggggcuacuucaagauccgcuccgggaaguccuccaucaugcggagcgacgcccccaucggcaagugcaacuccgagugcaucacgcccaacggcagcaucccgaacgacaagcccuuccagaacgugaaccgcaucaccuacggggccugcccccgguacgucaagcagaacacccugaagcuggccaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgccugcaucgggagcauccgcaacggcaccuacgaccacgacgucuaccgcgacgaggcgcugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 70154 - RNA, 1701 nt, Artificial Sequence
  derived and/or modified sequence opt1 from hemagglutinin__InfluenzaA__AFM72576
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcauccgcgggagcaacaacuccuucuucagccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccgcaucaccgugagcacgaagcggagccagcagaccgugauccccaacaucggcucccgcccccggguccgcaacauccccagccggaucuccaucuacuggaccaucgugaagccgggggacauccugcugaucaacagcaccggcaaccucaucgcgccccgcggguacuucaagauccgguccggcaagagcuccaucaugcgcagcgacgcccccaucggcaagugcaacuccgagugcaucacgcccaacgggagcaucccgaacgacaagcccuuccagaacgugaaccggaucaccuacggcgccugcccccgcuacgucaagcagaacacccugaagcuggccaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccucaagagcacccaggccgcgaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacaugggcaacgggugcuucaagaucuaccacaagugcgacaacgccugcaucggcagcauccggaacgggaccuacgaccacgacgucuaccgcgacgaggcgcugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 70155 - RNA, 1698 nt, Artificial Sequence
  derived and/or modified sequence opt1 from hemagglutinin__InfluenzaA__AFM72799
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccgggcacuucgccgacuacgaggagcugcgggagcagcucagcuccgugagcuccuucgagcgcuucgagaucuucccgaaggagagcuccuggcccaaccacacggucaccggcgugagcgccuccugcagccacaacggggaguccagcuucuacaagaaccugcuguggcucaccggcaagaacgggcuguaccccaaccuguccaagagcuacgccaacaacaaggagaaggaggugcucguccuguggggcgugcaccacccgcccaacaucggcaaccagaugacccuguaccacaaggagaacgccuacguguccgucgugagcagccacuacucccggaaguucacgcccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucagccgcggcuucggcuccgggaucaucaacagcaacgcccccauggacgagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggcuggaccgggaugguggacggcugguacggguaccaccaccagaacgagcagggcagcggcuacgccgcggaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucggcaacgggugcuucgaguucuaccacaagugcaacgacgagugcauggagagcgugaagaacggcaccuacgacuaccccaaguacuccgaggagagcaagcugucccgcgagaagaucgacggcgucaagcucgagagcauggggguguaccagauccuggcgaucuacuccaccguggccagcagccugguccuccuggugucccugggcgccaucagcuucuggaugugcuccaacgggagccuccagugccggaucugcaucuga

SEQ ID NO: 70156 - RNA, 1698 nt, Artificial Sequence; identical to SEQ ID NO: 70155
  derived and/or modified sequence opt1 from hemagglutinin__InfluenzaA__AFM72810

SEQ ID NO: 70157 - RNA, 1698 nt, Artificial Sequence; identical to SEQ ID NO: 70155
  derived and/or modified sequence opt1 from hemagglutinin__InfluenzaA__AFM72821

SEQ ID NO: 70158 - RNA, 1701 nt, Artificial Sequence
  derived and/or modified sequence opt1 from hemagglutinin__InfluenzaA__AFM72852
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccgacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagacguucaagccggagaucgccauccgccccaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagagcaccaagcugcgccucgcgaccggccugcggaacauccccuccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 70159 - RNA, 1701 nt, Artificial Sequence
  derived and/or modified sequence opt1 from hemagglutinin__InfluenzaA__AFM72862
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaacuccuacaucaacgacaagggcaaggaggugcugguccucugggggauccaccaccccagcaccagcgccgaccagcagucccuguaccagaacgccgacgccuacguguucgugggcagcucccgguacagcaagacguucaagccggagaucgccauccgccccaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagagcaccaagcugcgccucgcgaccggccugcggaacauccccuccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 70160 - RNA, 1701 nt, Artificial Sequence
  derived and/or modified sequence opt1 from hemagglutinin__InfluenzaA__AFM72872
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccggggagaucugcgacagcccccaccagauccucgacggcaagaacugcacgcugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaagaacagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuucccguacgcgcaggccagcgggcggaucacgguguccaccaagcgcagccagcagaccgccauccccaacaucggcagccggccccgcgugcggaacauccccucccgcaucagcaucuacuggaccaucgucaagccgggcgacauccugcugaucaacuccacggggaaccucaucgcgccccggggcuacuucaagauccgcagcgggaaguccagcaucaugcgguccgacgcccccaucggcaagugcaacagcgagugcaucacccccaacggcuccaucccgaacgacaagcccuuccagaacgugaaccgcaucaccuacggggccugcccccgguacgugaagcagaacacccugaagcuggccacgggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggcgugccagaaggggaacauccggugcaacaucugcaucuga

SEQ ID NO: 70161 - RNA, 1701 nt, Artificial Sequence
  derived and/or modified sequence opt1 from hemagglutinin__InfluenzaA__AFM72883
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgugaccgacaaggaccagaucuuccuguacgcgcaggccuccgggcggaucaccgugagcacgaagcgcucccagcagaccgucaucccgaacaucgggagccggccccgcgugcggaacauccccacccgcaucagcaucuacuggaccaucgugaagcccggcgacauccugcucaucaacuccacgggcaaccugaucgccccgcggggguacuucaagaugcagagcggcaaguccagcaucaugcgcuccgacgcccccaucgggaagugcaacagcgagugcaucacccccaacggcuccauccccaacgacaagccguuccagaacgucaaccggaucaccuacggcgccugcccccgcuacgugaagcagaacacccugaagcucgcgacggggaugcggaacgugcccgagaagcagacccgcggcaucuucggggccaucgccggcuucaucgagaacgggugggagggcauggucgacggcugguacggguuccggcaccagaacagcgagggccgcgggcaggccgccgaccugaaguccacccaggcggccaucgaccagaucaacggcaagcugaaccggcucaucgggaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggacguacgaccacaacguguaccgcgacgaggcccucaacaaccgguuccagaucaagggcguggagcucaagagcggguacaaggacuggauccuguggaucuccuucgccaucagcugcuuccugcugugcgucgcccugcucggcuucaucaugugggccugccagaagggcaacauccgcugcaacaucugcaucuga

SEQ ID NO: 70162 - RNA, 1701 nt, Artificial Sequence
  derived and/or modified sequence opt1 from hemagglutinin__InfluenzaA__AFM72894
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcaagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcagcugaacuucaaguaccccgcccugaacgugaccaugcccaacaacgagcaguucgacaagcucuacaucuggggcguccaccaccccgugaccgacaaggaccagaucuuccuguacgcgcaggccuccgggcggaucaccgugagcacgaagcgcucccagcagaccgucaucccgaacaucgggagccggccccgcgugcggaacauccccagccgcaucuccaucuacuggaccaucgugaagcccggcgacauccugcucaucaacagcaccggcaaccugaucgccccgcggggguacuucaagaugcaguccggcaagagcuccaucaugcgcagcgacgcccccaucgggaagugcaacuccgagugcaucacgcccaacggcagcauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacgggugggagggcauggucgacggcugguacggguuccggcaccagaacuccgagggccgcgggcaggccgccgaccucaagagcacccaggcggccaucgaccagaucaacggcaagcugaaccggcugaucgggaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacaugggcaacgggugcuucaagaucuaccacaagugcgacaacgcgugcaucggcagcauccgcaacgggaccuacgaccacaacguguaccgcgacgaggcccucaacaaccgguuccagaucaagggcguggagcugaaguccggguacaaggacuggauccuguggaucagcuucgccaucuccugcuuccuccugugcgucgcccugcucggcuucaucaugugggccugccagaagggcaacauccgcugcaacaucugcaucuga

SEQ ID NO: 70163 - RNA, 1701 nt, Artificial Sequence
  derived and/or modified sequence opt1 from hemagglutinin__InfluenzaA__AFM72916
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcaagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaagaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuucccguacgcgcaggccagcgggcggaucaccguguccacgaagcgcagccagcagaccgccauccccaacaucggcagccggccccgcgugcggaacauccccucccgcaucagcaucuacuggaccaucgucaagccgggcgacauccuccugaucaacuccaccgggaaccugaucgcgccccggggcuacuucaagauccgcagcgggaaguccagcaucaugcgguccgacgcccccaucggcaagugcaacagcggcugcaucacgcccaacggguccaucccgaacgacaagcccuuccagaacgugaaccgcaucaccuacggcgccugcccccgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggcuacaaggacugguuccucuggaucuccuucgccaucagcugcuuccugcugugcguggcccuccugggguucaucaugugggcgugccagaagggcaacauccggugcaacaucugcaucuga

SEQ ID NO: 70164 - RNA, 1701 nt, Artificial Sequence
  derived and/or modified sequence opt1 from hemagglutinin__InfluenzaA__AFM72927
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaccagccuguacgcgcaggccuccgggcggaucacggugagcaccaagcgcagccagcagaccgugaucccgaacaucggcucccggccccgcguccggaacauccccagccgcaucuccaucuacuggaccaucgugaagcccggcgacauccugcucaucaacagcaucgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70165 - RNA, 1701 nt, Artificial Sequence
  derived and/or modified sequence opt1 from hemagglutinin__InfluenzaA__AFM72938
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaccagccuguacgcgcaggccuccgggcggaucacggugagcaccaagcgcagccagcagaccgugaucccgaacaucggcucccggccccgcguccggaacaaccccagccgcaucuccaucuacuggaccaucgugaagcccggcgacauccugcucaucaacagcaucgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70166 - RNA, 1701 nt, Artificial Sequence
  derived and/or modified sequence opt1 from hemagglutinin__InfluenzaA__AFM72949
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcagcugaaguucaaguaccccgcccugaacgugaccaugcccaacaacgagcaguucgacaagcucuacaucuggggcguccaccaccccgggaccgacaacgaccagaccagccuguacgcgcaggccuccgggcggaucacggugagcaccaagcgcagccagcagaccgugaucccgaacaucggcucccggccccgcguccggaacaaccccagccgcaucuccaucuacuggaccaucgugaagcccggcgacauccugcucaucaacagcaucgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70167 - RNA, 1701 nt, Artificial Sequence
  derived and/or modified sequence opt1 from hemagglutinin__InfluenzaA__AFM72960
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaaguggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaccagccuguacgcgcaggccuccgggcggaucacggugagcaccaagcgcagccagcagaccgugaucccgaacaucggcucccggccccgcguccggaacauccccagccgcaucuccaucuacuggaccaucgugaagcccggcgacauccugcucaucaacagcaucgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70168 - RNA, 1701 nt, Artificial Sequence
  derived and/or modified sequence opt1 from hemagglutinin__InfluenzaA__AFM72971
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaaguggaccggggugacccagaacggcaccuccagcgccugcauccgccgguccaacaacagcuucuucucccgccugaacuggcucacgcagcugaacuucaaguaccccgcccugaacgugaccaugcccaacaacgagcaguucgacaagcucuacaucuggggcguccaccaccccgggaccgacaacgaccagaccagccuguacgcgcaggccuccgggcggaucacggugagcaccaagcgcagccagcagaccgugaucccgaacaucggcucccggccccgcguccggaacauccccagccgcaucuccaucuacuggaccaucgugaagcccggcgacauccugcucaucaacagcaucgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70169 - RNA, 1701 nt, Artificial Sequence
  derived and/or modified sequence opt1 from hemagglutinin__InfluenzaA__AFM72982
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacagcgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuucccguacgcgcaggccuccgggcggaucaccgugagcacgaagcgcagccagcaggccgugauccccaacaucggcucccggccccgcguccggaacauccccagccgcaucuccaucuacuggaccaucgugaagccgggcgacauccugcugaucaacagcaccgggaaccucaucgcgccccggggcuacuucaagauccgcuccgggaaguccuccaucaugcggagcgacgcccccaucggcaagugcaacuccgagugcaucacccccaacggcagcaucccgaacgacaagcccuuccagaacgugaaccgcaucacguacggggccugcccccgguacaucaagcaguccacccugaagcuggccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccucaaguccacgcaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucucccuggccaucagcugcuuccuccugugcguggcccugcucggcuucaucaugugggcgugccagaaggggaacauccggugcaacaucugcaucuga

SEQ ID NO: 70170 - RNA, 1701 nt, Artificial Sequence
  derived and/or modified sequence opt1 from hemagglutinin__InfluenzaA__AFM72993
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccugcaccccgggaccuacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccuccugaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcucaagcuggccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacccaggccgccaucgaccagaucaacgggaagcucaaccggcugaucggcaagacgaacgagaaguuccaccagaucgagaaggaguucuccgaggucgagggccgcauccaggaccuggagaaguacguggaggacaccaagaucgaccucuggagcuacaacgccgagcugcugguggcgcucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgccugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcguggcgcuccugggcuucaucaugugggccugccagaaggggaacauccgcugcaacaucugcaucuga

SEQ ID NO: 70171 - RNA, 1701 nt, Artificial Sequence
  derived and/or modified sequence opt1 from hemagglutinin__InfluenzaA__AFM73004
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccugcaccccgggaccuacaaggaccagaucuuccuguacgcccaggccagcgggcgcgugaccguguccaccaagcggagccagcaggccgucaucccgaacaucggcagccgcccccgggugcgcaacauccccucccggaucagcaucuacuggacgaucgugaagcccggcgacauccuccugaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgucaaccggaucaccuacggggccugcccccgcuacgugaagcagagcacgcucaagcuggccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggcggccgaccugaaguccacccaggccgccaucgaccagaucaacgggaagcucaaccggcugaucggcaagacgaacgagaaguuccaccagaucgagaaggaguucuccgagguggagggccgcauccaggaccuggagaaguacguggaggacaccaagaucgaccucuggagcuacaacgccgagcugcuggucgcgcucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgccugcaucgggagcauccggaacggcaccuacgaccacgacguguaccgcgacgaggcccugaacaaccgguuccagaucaaggggguggagcugaaguccggcuacaaggacuggauccucuggaucagcuucgccaucuccugcuucuuccugugcgucgcgcugcucggcuucaucaugugggccugccagaaggggaacauccgcugcaacaucugcaucuga

SEQ ID NO: 70172 - RNA, 1701 nt, Artificial Sequence
  derived and/or modified sequence opt1 from hemagglutinin__InfluenzaA__AFM73015
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccgcgaggggcggaugaacuacuacuggacccugguggagcccggcgacaagaucacguucgaggccaccgggaaccucguggucccccgcuacgcguucgccauggagcggaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcgccucgccaccgggcugcggaacgugccguccauccagagccgcggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacgcuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggccaucuacagcaccgucgcguccagccuggugcucguggucucccugggcgccaucagcuucuggaugugcagcaacggcucccugcagugccgcaucugcaucuga

SEQ ID NO: 70173 - RNA, 1701 nt, Artificial Sequence
  derived and/or modified sequence opt1 from hemagglutinin__InfluenzaA__AFM73025
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggacgaccagcagagccuguaccagaacgccgacaccuacguguucgugggcaccucccgguacagcaagaaguucaagcccgagaucgccauccgcccgaagguccgggaccgcgaggggcggaugaacuacuacuggacccugguggagcccggcgacaagaucacguucgaggccaccgggaaccucguggucccccgcuacgccuucgcgauggagcggaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcgccucgccaccgggcugcggaacgugccguccauccagagccgcggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgccgugggcaaggaguucaaccaccuggagaagcggaucgagaaccugaacaagaaggucgacgacggguuccucgacaucuggaccuacaacgcggagcugcuggugcuccuggagaacgagcgcacgcuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggccaucuacagcaccgucgccuccagccuggugcucguggucucccugggcgcgaucagcuucuggaugugcagcaacggcucccugcagugccgcaucugcaucuga

SEQ ID NO: 70174 - RNA, 1701 nt, Artificial Sequence; identical to SEQ ID NO: 70173
  derived and/or modified sequence opt1 from hemagglutinin__InfluenzaA__AFM73035

SEQ ID NO: 70175 - RNA, 1701 nt, Artificial Sequence
  derived and/or modified sequence opt1 from hemagglutinin__InfluenzaA__AFM73045
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70176 - RNA, 1701 nt, Artificial Sequence
  derived and/or modified sequence opt1 from hemagglutinin__InfluenzaA__AFM73055
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucguggagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70177 - RNA, 1701 nt, Artificial Sequence
  derived and/or modified sequence opt1 from hemagglutinin__InfluenzaA__AFM73065
augaaggccauccuggugguccuccuguacaccuucgccaccgcgaacgccgacacgcugugcaucggcuaccacgccaacaacagcaccgacaccguggacaccgugcucgagcgcaacgucacggugacccacuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaaggaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70178 - RNA, 1701 nt, Artificial Sequence; identical to SEQ ID NO: 61923
  derived and/or modified sequence opt1 from hemagglutinin__InfluenzaA__AFM73477

SEQ ID NO: 70179 - RNA, 1707 nt, Artificial Sequence
  derived and/or modified sequence opt1 from hemagglutinin__InfluenzaA__AFM78567
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagaucgccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacagcccccagcgggagagccgccggaagaagcgcggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucagcggggucaagcuggaguccaucggcacguaccagauccucagcaucuacuccaccguggccagcagccuggcgcuggccaucaugauggccgggcucucccuguggaugugcagcaacggcucccugcagugccgcaucugcaucuga

SEQ ID NO: 70180 - RNA, 1701 nt, Artificial Sequence
  derived and/or modified sequence opt1 from hemagglutinin__InfluenzaA__AFM78646
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagggccuguaccagaacgccgacgccuacguguucgugggcacgucccgguacagcaagaaguucaagccggagaucgccauccgccccaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgccggugcacgacugcaacacgaccugccagacccccaagggggccaucaacaccucccugcccuuccagaacauccaccccaucaccaucggcaagugcccgaaguacgucaagagcaccaagcugcggcucgcgaccgggcugcgcaacgugcccuccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcucccuggugcucguggucagccugggcgccaucagcuucuggaugugcuccaacggcagccugcagugccggaucugcaucuga

SEQ ID NO: 70181 - RNA, 1698 nt, Artificial Sequence
  derived and/or modified sequence opt1 from hemagglutinin__InfluenzaA__AFM85179
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacgcuguacuacaccgagaacgccuacgucagcguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaucuccaacgcccccauggacgagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucaccaacaaggucaacagcgugaucgagaagaugaacacgcaguucaccgccguggggaaggaguucaacaaguucgagcgccggauggagaaccugaacaagaaggucgacgacggcuuccucgacaucuggaccuacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcugaaccgggagaagaucgacggcgucaagcucgaguccaugggcguguaccagauccuggccaucuacagcaccguggcgagcucccugguccuccuggugagccugggggccaucuccuucuggaugugcagcaacggcucccuccagugccgcaucugcaucuga

SEQ ID NO: 70182 - RNA, 1701 nt, Artificial Sequence
  derived and/or modified sequence opt1 from hemagglutinin__InfluenzaA__AFN11846
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgucaagagcuucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 70183 - RNA, 1701 nt, Artificial Sequence; identical to SEQ ID NO: 64538
  derived and/or modified sequence opt1 from hemagglutinin__InfluenzaA__AFN17371

SEQ ID NO: 70184 - RNA, 1701 nt, Artificial Sequence; identical to SEQ ID NO: 63677
  derived and/or modified sequence opt1 from hemagglutinin__InfluenzaA__AFN17381

SEQ ID NO: 70185 - RNA, 1701 nt, Artificial Sequence; identical to SEQ ID NO: 63677
  derived and/or modified sequence opt1 from hemagglutinin__InfluenzaA__AFN17391

SEQ ID NO: 70186 - RNA, 1701 nt, Artificial Sequence; identical to SEQ ID NO: 63677
  derived and/or modified sequence opt1 from hemagglutinin__InfluenzaA__AFN17401

SEQ ID NO: 70187 - RNA, 1701 nt, Artificial Sequence; identical to SEQ ID NO: 63677
  derived and/or modified sequence opt1 from hemagglutinin__InfluenzaA__AFN17411

SEQ ID NO: 70188 - RNA, 1701 nt, Artificial Sequence; identical to SEQ ID NO: 63677
  derived and/or modified sequence opt1 from hemagglutinin__InfluenzaA__AFN17421

SEQ ID NO: 70189 - RNA, 1701 nt, Artificial Sequence; identical to SEQ ID NO: 63768
  derived and/or modified sequence opt1 from hemagglutinin__InfluenzaA__AFN17431

SEQ ID NO: 70190 - RNA, 1701 nt, Artificial Sequence
  derived and/or modified sequence opt1 from hemagglutinin__InfluenzaA__AFN17441
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaaggccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70191 - RNA, 1701 nt, Artificial Sequence; identical to SEQ ID NO: 66232
  derived and/or modified sequence opt1 from hemagglutinin__InfluenzaA__AFN17451

SEQ ID NO: 70192 - RNA, 1701 nt, Artificial Sequence; identical to SEQ ID NO: 64519
  derived and/or modified sequence opt1 from hemagglutinin__InfluenzaA__AFN17467

SEQ ID NO: 70193 - RNA, 1701 nt, Artificial Sequence; identical to SEQ ID NO: 63677
  derived and/or modified sequence opt1 from hemagglutinin__InfluenzaA__AFN17477

SEQ ID NO: 70194 - RNA, 1701 nt, Artificial Sequence; identical to SEQ ID NO: 64538
  derived and/or modified sequence opt1 from hemagglutinin__InfluenzaA__AFN17487

SEQ ID NO: 70195 - RNA, 1701 nt, Artificial Sequence; identical to SEQ ID NO: 63677
  derived and/or modified sequence opt1 from hemagglutinin__InfluenzaA__AFN17497

SEQ ID NO: 70196 - RNA, 1701 nt, Artificial Sequence; identical to SEQ ID NO: 63677
  derived and/or modified sequence opt1 from hemagglutinin__InfluenzaA__AFN17507

SEQ ID NO: 70197 - RNA, 1701 nt, Artificial Sequence; identical to SEQ ID NO: 64519
  derived and/or modified sequence opt1 from hemagglutinin__InfluenzaA__AFN17517

SEQ ID NO: 70198 - RNA, 1701 nt, Artificial Sequence; identical to SEQ ID NO: 64538
  derived and/or modified sequence opt1 from hemagglutinin__InfluenzaA__AFN17527

SEQ ID NO: 70199 - RNA, 1701 nt, Artificial Sequence; identical to SEQ ID NO: 63677
  derived and/or modified sequence opt1 from hemagglutinin__InfluenzaA__AFN17537

SEQ ID NO: 70200 - RNA, 1701 nt, Artificial Sequence; identical to SEQ ID NO: 63919
  derived and/or modified sequence opt1 from hemagglutinin__InfluenzaA__AFN17547

SEQ ID NO: 70201 - RNA, 1701 nt, Artificial Sequence; identical to SEQ ID NO: 65208
  derived and/or modified sequence opt1 from hemagglutinin__InfluenzaA__AFN17557

SEQ ID NO: 70202 - RNA, 1701 nt, Artificial Sequence; identical to SEQ ID NO: 64519
  derived and/or modified sequence opt1 from hemagglutinin__InfluenzaA__AFN17567

SEQ ID NO: 70203 - RNA, 1701 nt, Artificial Sequence; identical to SEQ ID NO: 63919
  derived and/or modified sequence opt1 from hemagglutinin__InfluenzaA__AFN17574

SEQ ID NO: 70204 - RNA, 1701 nt, Artificial Sequence; identical to SEQ ID NO: 63677
  derived and/or modified sequence opt1 from hemagglutinin__InfluenzaA__AFN17580

SEQ ID NO: 70205 - RNA, 1701 nt, Artificial Sequence; identical to SEQ ID NO: 63677
  derived and/or modified sequence opt1 from hemagglutinin__InfluenzaA__AFN17586

SEQ ID NO: 70206 - RNA, 1701 nt, Artificial Sequence; identical to SEQ ID NO: 64538
  derived and/or modified sequence opt1 from hemagglutinin__InfluenzaA__AFN17595

SEQ ID NO: 70207 - RNA, 1701 nt, Artificial Sequence; identical to SEQ ID NO: 63677
  derived and/or modified sequence opt1 from hemagglutinin__InfluenzaA__AFN17605

SEQ ID NO: 70208 - RNA, 1701 nt, Artificial Sequence; identical to SEQ ID NO: 63677
  derived and/or modified sequence opt1 from hemagglutinin__InfluenzaA__AFN17615

SEQ ID NO: 70209 - RNA, 1701 nt, Artificial Sequence; identical to SEQ ID NO: 63677
  derived and/or modified sequence opt1 from hemagglutinin__InfluenzaA__AFN17625

SEQ ID NO: 70210 - RNA, 1701 nt, Artificial Sequence; identical to SEQ ID NO: 63677
  derived and/or modified sequence opt1 from hemagglutinin__InfluenzaA__AFN17635

SEQ ID NO: 70211 - RNA, 1701 nt, Artificial Sequence
  derived and/or modified sequence opt1 from hemagglutinin__InfluenzaA__AFN17645
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcgucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70212 - RNA, 1701 nt, Artificial Sequence; identical to SEQ ID NO: 64538
  derived and/or modified sequence opt1 from hemagglutinin__InfluenzaA__AFN17655

SEQ ID NO: 70213 - RNA, 1701 nt, Artificial Sequence; identical to SEQ ID NO: 64538
  derived and/or modified sequence opt1 from hemagglutinin__InfluenzaA__AFN17665

SEQ ID NO: 70214 - RNA, 1701 nt, Artificial Sequence
  derived and/or modified sequence opt1 from hemagglutinin__InfluenzaA__AFN17675
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccgagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 70215 - RNA, 1701 nt, Artificial Sequence
  derived and/or modified sequence opt1 from hemagglutinin__InfluenzaA__AFN17685
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagccccgggacaagaucaccuucgaggcgaccgggaaccucguggugccccgcuacgccuucgccauggagcggaacgccggcuccgggaucaucaucagcgacacgcccguccacgacugcaacacgaccugccagaccccgaagggcgccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgugaucgagaagaugaacacccaguucacggccgucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcucgagagcacccggaucuaccagauccuggcgaucuacuccaccguggccagcagccugguccucguggugucccugggcgccaucagcuucuggaugugcuccaacgggagccugcagugccgcaucugcaucuga

SEQ ID NO: 70216 - RNA, 1701 nt, Artificial Sequence; identical to SEQ ID NO: 63677
  derived and/or modified sequence opt1 from hemagglutinin__InfluenzaA__AFN17695

SEQ ID NO: 70217 - RNA, 1701 nt, Artificial Sequence; identical to SEQ ID NO: 63677
  derived and/or modified sequence opt1 from hemagglutinin__InfluenzaA__AFN17705

SEQ ID NO: 70218 - RNA, 1701 nt, Artificial Sequence; identical to SEQ ID NO: 64306
  derived and/or modified sequence opt1 from hemagglutinin__InfluenzaA__AFN17715

SEQ ID NO: 70219 - RNA, 1701 nt, Artificial Sequence
  derived and/or modified sequence opt1 from hemagglutinin__InfluenzaA__AFN17725
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgcagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70220 - RNA, 1701 nt, Artificial Sequence; identical to SEQ ID NO: 63677
  derived and/or modified sequence opt1 from hemagglutinin__InfluenzaA__AFN17735

SEQ ID NO: 70221 - RNA, 1701 nt, Artificial Sequence; identical to SEQ ID NO: 63677
  derived and/or modified sequence opt1 from hemagglutinin__InfluenzaA__AFN17742

SEQ ID NO: 70222 - RNA, 1701 nt, Artificial Sequence; identical to SEQ ID NO: 63677
  derived and/or modified sequence opt1 from hemagglutinin__InfluenzaA__AFN17748

SEQ ID NO: 70223 - RNA, 1701 nt, Artificial Sequence; identical to SEQ ID NO: 63677
  derived and/or modified sequence opt1 from hemagglutinin__InfluenzaA__AFN17757

SEQ ID NO: 70224 - RNA, 1701 nt, Artificial Sequence; identical to SEQ ID NO: 64306
  derived and/or modified sequence opt1 from hemagglutinin__InfluenzaA__AFN17767

SEQ ID NO: 70225 - RNA, 1701 nt, Artificial Sequence; identical to SEQ ID NO: 68687
  derived and/or modified sequence opt1 from hemagglutinin__InfluenzaA__AFN17774

SEQ ID NO: 70226 - RNA, 1701 nt, Artificial Sequence; identical to SEQ ID NO: 63677
  derived and/or modified sequence opt1 from hemagglutinin__InfluenzaA__AFN17783

SEQ ID NO: 70227 - RNA, 1701 nt, Artificial Sequence; identical to SEQ ID NO: 64306
  derived and/or modified sequence opt1 from hemagglutinin__InfluenzaA__AFN17793

SEQ ID NO: 70228 - RNA, 1701 nt, Artificial Sequence; identical to SEQ ID NO: 63677
  derived and/or modified sequence opt1 from hemagglutinin__InfluenzaA__AFN17803

SEQ ID NO: 70229 - RNA, 1701 nt, Artificial Sequence; identical to SEQ ID NO: 63677
  derived and/or modified sequence opt1 from hemagglutinin__InfluenzaA__AFN17813

SEQ ID NO: 70230 - RNA, 1701 nt, Artificial Sequence
  derived and/or modified sequence opt1 from hemagglutinin__InfluenzaA__AFN17823
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccgagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70231 - RNA, 1701 nt, Artificial Sequence
  derived and/or modified sequence opt1 from hemagglutinin__InfluenzaA__AFN17833
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgaacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70232 - RNA, 1701 nt, Artificial Sequence; identical to SEQ ID NO: 68186
  derived and/or modified sequence opt1 from hemagglutinin__InfluenzaA__AFN17843

SEQ ID NO: 70233 - RNA, 1701 nt, Artificial Sequence; identical to SEQ ID NO: 63677
  derived and/or modified sequence opt1 from hemagglutinin__InfluenzaA__AFN17853

SEQ ID NO: 70234 - RNA, 1701 nt, Artificial Sequence; identical to SEQ ID NO: 63919
  derived and/or modified sequence opt1 from hemagglutinin__InfluenzaA__AFN17863

SEQ ID NO: 70235 - RNA, 1701 nt, Artificial Sequence
  derived and/or modified sequence opt1 from hemagglutinin__InfluenzaA__AFN17873
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccggcagcugguccuacaucguggagaccagcuccagcgacaacggcacgugcuaccccggggacuucaucgacuacgaggagcuccgggagcagcuguccagcguguccagcuucgagcgcuucgagaucuuccccaagaccuccagcuggcccaaccacgaccugaacaagggcgucaccgccgccugcccgcacgccggggcgaaguccuucuacaagaaccucaucuggcuggugaagaagggcaacagcuaccccaagcuguccaagagcuacaucaacgacaaggggaaggaggugcucguccuguggggcauccaccaccccuccaccagcgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccucguggagcccggcgacaagaucaccuucgaggcgaccgggaaccugguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcuccggcuggcgaccgggcugcgcaacgugccguccauccagagccggggccucuucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccuggacaucuggaccuacaacgccgagcugcucgugcugcuggagaacgagcggacccucgacuaccacgacagcaacgugaagaaccuguacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgggaggagaucgacggggugaagcuggagagcacccgcaucuaccagauccuggcgaucuacuccaccgucgccagcucccucgugcugguggucagccugggcgccaucagcuucuggaugugcuccaacggcagccuccagugccggaucugcaucuga

SEQ ID NO: 70236 - RNA, 1701 nt, Artificial Sequence
  derived and/or modified sequence opt1 from hemagglutinin__InfluenzaA__AFN17883
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagacccugaagggcgccaucaacaccucccugccguuccagaacauccaccccaucaccaucgggaagugccccaaguacgucaagagcaccaagcuccggcuggcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 70237 - RNA, 1701 nt, Artificial Sequence; identical to SEQ ID NO: 63677
  derived and/or modified sequence opt1 from hemagglutinin__InfluenzaA__AFN17893

SEQ ID NO: 70238 - RNA, 1701 nt, Artificial Sequence
  derived and/or modified sequence opt1 from hemagglutinin__InfluenzaA__AFN17903
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgagagcaacaagggggucaccgccgccugcccgcacgccggcgcgaaguccuucuacaagaaccugaucuggcucgugaagaaggggaacagcuaccccaagcuguccaagagcuacgugaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70239 - RNA, 1701 nt, Artificial Sequence; identical to SEQ ID NO: 64030
  derived and/or modified sequence opt1 from hemagglutinin__InfluenzaA__AFN17919

SEQ ID NO: 70240 - RNA, 1701 nt, Artificial Sequence; identical to SEQ ID NO: 63919
  derived and/or modified sequence opt1 from hemagglutinin__InfluenzaA__AFN17929

SEQ ID NO: 70241 - RNA, 1701 nt, Artificial Sequence; identical to SEQ ID NO: 69935
  derived and/or modified sequence opt1 from hemagglutinin__InfluenzaA__AFN17939

SEQ ID NO: 70242 - RNA, 1701 nt, Artificial Sequence; identical to SEQ ID NO: 64538
  derived and/or modified sequence opt1 from hemagglutinin__InfluenzaA__AFN17949

SEQ ID NO: 70243 - RNA, 1701 nt, Artificial Sequence
  derived and/or modified sequence opt1 from hemagglutinin__InfluenzaA__AFN17959
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacgugaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70244 - RNA, 1701 nt, Artificial Sequence; identical to SEQ ID NO: 65359
  derived and/or modified sequence opt1 from hemagglutinin__InfluenzaA__AFN17969

SEQ ID NO: 70245 - RNA, 1701 nt, Artificial Sequence; identical to SEQ ID NO: 64538
  derived and/or modified sequence opt1 from hemagglutinin__InfluenzaA__AFN17979

SEQ ID NO: 70246 - RNA, 1701 nt, Artificial Sequence
  derived and/or modified sequence opt1 from hemagglutinin__InfluenzaA__AFN17989
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucggcaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 70247 - RNA, 1701 nt, Artificial Sequence; identical to SEQ ID NO: 63677
  derived and/or modified sequence opt1 from hemagglutinin__InfluenzaA__AFN17999

SEQ ID NO: 70248 - RNA, 1701 nt, Artificial Sequence
  derived and/or modified sequence opt1 from hemagglutinin__InfluenzaA__AFN18019
augaaggccauccuggugguccuccuguacaccuucgccaccgcgaaggccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70249 - RNA, 1701 nt, Artificial Sequence; identical to SEQ ID NO: 64538
  derived and/or modified sequence opt1 from hemagglutinin__InfluenzaA__AFN18039

SEQ ID NO: 70250 - RNA, 1701 nt, Artificial Sequence; identical to SEQ ID NO: 63677
  derived and/or modified sequence opt1 from hemagglutinin__InfluenzaA__AFN18049

SEQ ID NO: 70251 - RNA, 1701 nt, Artificial Sequence
  derived and/or modified sequence opt1 from hemagglutinin__InfluenzaA__AFN18059
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacgccugcauggagagcgugaagaacgggaccuacgacuaccccaaguacuccgaggaggcgaagcugaaccgggaggagaucgacggcgugaagcucgagagcacgcgcaucuaccagauccuggccaucuacuccaccgucgccagcagccuggugcucguggucucccugggggccaucagcuucuggaugugcuccaacggcagccugcagugccggaucugcaucuga

SEQ ID NO: 70252 - RNA, 1701 nt, Artificial Sequence; identical to SEQ ID NO: 63677
  derived and/or modified sequence opt1 from hemagglutinin__InfluenzaA__AFN18078

SEQ ID NO: 70253 - RNA, 1701 nt, Artificial Sequence
  derived and/or modified sequence opt1 from hemagglutinin__InfluenzaA__AFN18088
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggugcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 70254 - RNA, 1701 nt, Artificial Sequence
  derived and/or modified sequence opt1 from hemagglutinin__InfluenzaA__AFN18098
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcaacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccgucgagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70255 - RNA, 1701 nt, Artificial Sequence
  derived and/or modified sequence opt1 from hemagglutinin__InfluenzaA__AFN18105
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacaccaacugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 70256 - RNA, 1701 nt, Artificial Sequence; identical to SEQ ID NO: 63919
  derived and/or modified sequence opt1 from hemagglutinin__InfluenzaA__AFN18107

SEQ ID NO: 70257 - RNA, 1701 nt, Artificial Sequence; identical to SEQ ID NO: 70251
  derived and/or modified sequence opt1 from hemagglutinin__InfluenzaA__AFN18117

SEQ ID NO: 70258 - RNA, 1701 nt, Artificial Sequence; identical to SEQ ID NO: 63677
  derived and/or modified sequence opt1 from hemagglutinin__InfluenzaA__AFN18119

SEQ ID NO: 70259 - RNA, 1701 nt, Artificial Sequence
  derived and/or modified sequence opt1 from hemagglutinin__InfluenzaA__AFN18121
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgcgguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggugcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggcgaucuacuccaccguggccagcagccuggugcucgucgugucccugggggccaucagcuucuggaugugcuccaacggcagccugcagugccgcaucugcaucuga

SEQ ID NO: 70260 - RNA, 1701 nt, Artificial Sequence; identical to SEQ ID NO: 70251
  derived and/or modified sequence opt1 from hemagglutinin__InfluenzaA__AFN18133

SEQ ID NO: 70261 - RNA, 1701 nt, Artificial Sequence; identical to SEQ ID NO: 69935
  derived and/or modified sequence opt1 from hemagglutinin__InfluenzaA__AFN18135

SEQ ID NO: 70262 - RNA, 1701 nt, Artificial Sequence; identical to SEQ ID NO: 64519
  derived and/or modified sequence opt1 from hemagglutinin__InfluenzaA__AFN18137

SEQ ID NO: 70263 - RNA, 1701 nt, Artificial Sequence
  derived and/or modified sequence opt1 from hemagglutinin__InfluenzaA__AFN18139
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagggccuguaccagaacgccgacgccuacguguucgugggcagcucccgguacagcaagaaguucaagcccgagaucgccauccgcccgaagguccgggaccaggaggggcgcaugaacuacuacuggacgcugguggagcccggcgacaagaucaccuucgaggcgaccgggaaccucguggucccccgguacgccuucgccauggagcgcaacgccggcuccggcaucaucaucagcgacacccccgugcacgacugcaacacgaccugccagaccccgaagggggccaucaacaccucccugcccuuccacaacauccaccccaucacgaucggcaagugccccaaguacgucaagagcaccaagcugcggcucgcgaccgggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 70264 - RNA, 1701 nt, Artificial Sequence; identical to SEQ ID NO: 70259
  derived and/or modified sequence opt1 from hemagglutinin__InfluenzaA__AFN18141

SEQ ID NO: 70265 - RNA, 1701 nt, Artificial Sequence; identical to SEQ ID NO: 64538
  derived and/or modified sequence opt1 from hemagglutinin__InfluenzaA__AFN18148

SEQ ID NO: 70266 - RNA, 1701 nt, Artificial Sequence; identical to SEQ ID NO: 64841
  derived and/or modified sequence opt1 from hemagglutinin__InfluenzaA__AFN18155

SEQ ID NO: 70267 - RNA, 1701 nt, Artificial Sequence
  derived and/or modified sequence opt1 from hemagglutinin__InfluenzaA__AFN18157
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacgccuucgugggcacgucccgguacagcaagaaguucaagcccgagaucgcgauccgcccgaaggugcgggaccaggaggggcgcaugaacuacuacuggacccuggucgagcccggcgacaagaucaccuucgaggccaccgggaaccucguggugccccgguacgccuucgccauggagcgcaacgccggcuccggcaucaucaucagcgacacgcccguccacgacugcaacacgaccugccagaccccgaagggggcgaucaacaccucccugcccuuccagaacauccaccccaucaccaucggcaagugccccaaguacgucaagagcaccaagcugcggcucgccaccgggcugcgcaacgugccguccauccagagccggggccuguucggggccaucgccggcuucaucgagggcggguggacgggcaugguggacgggugguacggcuaccaccaccagaacgagcagggguccggcuacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggcgaagcugaaccgggaggagaucgacggggugaagcucgagagcacccgcaucuaccagauccuggccaucuacuccaccguggccagcagccugguccucguggugucccugggcgccaucagcuucuggaugugcuccaacggcagccugcagugccggaucugcaucuga

SEQ ID NO: 70268 - RNA, 1701 nt, Artificial Sequence
  derived and/or modified sequence opt1 from hemagglutinin__InfluenzaA__AFN18159
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcuccaagagcuucuacaagaaccugaucuggcucgugaagaaggggaacuccuaccccaagcugagcaagagcuacaucaacgacaagggcaaggaggugcugguccucugggggauccaccaccccuccaccagcgcggaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagagcaccaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacgcagaacgccaucgacgagaucaccaacaaggugaacuccgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 70269 - RNA, 1701 nt, Artificial Sequence
  derived and/or modified sequence opt1 from hemagglutinin__InfluenzaA__AFN18164
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucaucgugccccgguacgcguucgccauggagcgcaacgccggguccggcaucaucaucagcaacacccccguccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgugaucgagaagaugaacacgcaguucaccgcggucggcaaggagcugaaccaccuggagaagcgcaucgagaaccucaacaagaagguggacgacggcuuccuggacaucuggaccuacaacgccgagcugcucguccugcuggagaacgagcggacccucgacuaccacgacagcaacgugaagaaccuguacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggccguguacuccaccgucgcgagcagccucgugcugguggucucccugggggccaucagcuucuggaugugcuccaacggcagccuccagugccggaucugcaucuga

SEQ ID NO: 70270 - RNA, 1701 nt, Artificial Sequence
  derived and/or modified sequence opt1 from hemagglutinin__InfluenzaA__AFN18171
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacagcgggaagcucugcaagcugcgcggcgucgcgccccugcaccucgggaagugcaacaucgccggcuggauccuggggaacccggagugcgagucccugagcaccgcguccagcugguccuacaucguggagaccagcuccagcgacaacggcaagugcuaccccggcgacuucaucgacuacgaggagcuccgggagcagcuguccagcguguccagcuucgagcgcuucgagaucuuccccaagacguccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcaccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugaaggacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 70271 - RNA, 1701 nt, Artificial Sequence
  derived and/or modified sequence opt1 from hemagglutinin__InfluenzaA__AFN18176
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccuccuggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcuccggcuggcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgucaagaaccuguacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgucaagcuggagagcacccgcaucuaccagauccuggcgaucuacuccaccguggccagcagccucgugcuggucgugucccugggggccaucagcuucuggaugugcuccaacggcagccuccagugccggaucugcaucuga

SEQ ID NO: 70272 - RNA, 1701 nt, Artificial Sequence
  derived and/or modified sequence opt1 from hemagglutinin__InfluenzaA__AFN18183
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucauggugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70273 - RNA, 1701 nt, Artificial Sequence; identical to SEQ ID NO: 65229
  derived and/or modified sequence opt1 from hemagglutinin__InfluenzaA__AFN18195

SEQ ID NO: 70274 - RNA, 1701 nt, Artificial Sequence; identical to SEQ ID NO: 63677
  derived and/or modified sequence opt1 from hemagglutinin__InfluenzaA__AFN18200

SEQ ID NO: 70275 - RNA, 1701 nt, Artificial Sequence
  derived and/or modified sequence opt1 from hemagglutinin__InfluenzaA__AFN18207
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagagccugaucuggcucgugaagaaggggaacuccuaccccaagcugagcaagagcuacaucaacgacaagggccgggaggugcugguccucugggggauccaccaccccuccaccagcgccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 70276 - RNA, 1701 nt, Artificial Sequence
  derived and/or modified sequence opt1 from hemagglutinin__InfluenzaA__AFN18214
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucaacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccgccgccagcucccuggugcugguggucagccucggggccaucuccuucuggaugugcagcaacggcucccugcagugccggaucugcaucuga

SEQ ID NO: 70277 - RNA, 1701 nt, Artificial Sequence; identical to SEQ ID NO: 66232
  derived and/or modified sequence opt1 from hemagglutinin__InfluenzaA__AFN18224

SEQ ID NO: 70278 - RNA, 1701 nt, Artificial Sequence; identical to SEQ ID NO: 65229
  derived and/or modified sequence opt1 from hemagglutinin__InfluenzaA__AFN18231

SEQ ID NO: 70279 - RNA, 1701 nt, Artificial Sequence
  derived and/or modified sequence opt1 from hemagglutinin__InfluenzaA__AFN18233
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacucccgcaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaagcucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 70280 - RNA, 1701 nt, Artificial Sequence
  derived and/or modified sequence opt1 from hemagglutinin__InfluenzaA__AFN18243
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 70281 - RNA, 1701 nt, Artificial Sequence; identical to SEQ ID NO: 69766
  derived and/or modified sequence opt1 from hemagglutinin__InfluenzaA__AFN18245

SEQ ID NO: 70282 - RNA, 1701 nt, Artificial Sequence; identical to SEQ ID NO: 66232
  derived and/or modified sequence opt1 from hemagglutinin__InfluenzaA__AFN18255

SEQ ID NO: 70283 - RNA, 1701 nt, Artificial Sequence; identical to SEQ ID NO: 70280
  derived and/or modified sequence opt1 from hemagglutinin__InfluenzaA__AFN18260

SEQ ID NO: 70284 - RNA, 1701 nt, Artificial Sequence; identical to SEQ ID NO: 70280
  derived and/or modified sequence opt1 from hemagglutinin__InfluenzaA__AFN18267

SEQ ID NO: 70285 - RNA, 1701 nt, Artificial Sequence
  derived and/or modified sequence opt1 from hemagglutinin__InfluenzaA__AFN18269
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagaaguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70286 - RNA, 1701 nt, Artificial Sequence; identical to SEQ ID NO: 64841
  derived and/or modified sequence opt1 from hemagglutinin__InfluenzaA__AFN18271

SEQ ID NO: 70287 - RNA, 1701 nt, Artificial Sequence; identical to SEQ ID NO: 65229
  derived and/or modified sequence opt1 from hemagglutinin__InfluenzaA__AFN18273

SEQ ID NO: 70288 - RNA, 1701 nt, Artificial Sequence; identical to SEQ ID NO: 64841
  derived and/or modified sequence opt1 from hemagglutinin__InfluenzaA__AFN18280

SEQ ID NO: 70289 - RNA, 1701 nt, Artificial Sequence; identical to SEQ ID NO: 64475
  derived and/or modified sequence opt1 from hemagglutinin__InfluenzaA__AFN18303

SEQ ID NO: 70290 - RNA, 1701 nt, Artificial Sequence
  derived and/or modified sequence opt1 from hemagglutinin__InfluenzaA__AFN18305
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgcgggcgccaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgcgauccgcccgaaggugcgggaccaggagggccgcaugaacuacuacuggacccuggucgagcccggggacaagaucaccuucgaggccaccggcaaccucguggugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccugggcaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggcgaagcugaaccgggaggagaucgacggggugaagcucgagagcacccgcaucuaccagauccuggccaucuacuccaccguggccagcagccugguccucguggugucccugggcgccaucagcuucuggaugugcuccaacggcagccugcagugccggaucugcaucuga

SEQ ID NO: 70291 - RNA, 1701 nt, Artificial Sequence
  derived and/or modified sequence opt1 from hemagglutinin__InfluenzaA__AFN18307
augaaggccauccuggugguccuccuguacaccuucgccgcggccaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacaccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70292 - RNA, 1701 nt, Artificial Sequence
  derived and/or modified sequence opt1 from hemagglutinin__InfluenzaA__AFN18312
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucgugaucucccugggggccaucagcuucuggaugugcuccaacggcagccugcagugccggaucugcaucuga

SEQ ID NO: 70293 - RNA, 1701 nt, Artificial Sequence; identical to SEQ ID NO: 66042
  derived and/or modified sequence opt1 from hemagglutinin__InfluenzaA__AFN18319

SEQ ID NO: 70294 - RNA, 1701 nt, Artificial Sequence; identical to SEQ ID NO: 68139
  derived and/or modified sequence opt1 from hemagglutinin__InfluenzaA__AFN18324

SEQ ID NO: 70295 - RNA, 1701 nt, Artificial Sequence; identical to SEQ ID NO: 64030
  derived and/or modified sequence opt1 from hemagglutinin__InfluenzaA__AFN18334

SEQ ID NO: 70296 - RNA, 1701 nt, Artificial Sequence; identical to SEQ ID NO: 65793
  derived and/or modified sequence opt1 from hemagglutinin__InfluenzaA__AFN18344

SEQ ID NO: 70297 - RNA, 1701 nt, Artificial Sequence; identical to SEQ ID NO: 63677
  derived and/or modified sequence opt1 from hemagglutinin__InfluenzaA__AFN18354

SEQ ID NO: 70298 - RNA, 1701 nt, Artificial Sequence
  derived and/or modified sequence opt1 from hemagglutinin__InfluenzaA__AFN18364
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgaccugaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccucguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccggcuggcgaccggccugcgcaacgucccgagcauccagucccggggccucuucggggccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccuggagaagcgcaucgagaaccucaacaagaagaucgacgacggcuuccuggacaucuggaccuacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacagcaccguggccuccagccucguccugguggugagccugggggccaucuccuucuggaugugcagcaacggcucccuccagugccggaucugcaucuga

SEQ ID NO: 70299 - RNA, 1701 nt, Artificial Sequence; identical to SEQ ID NO: 63677
  derived and/or modified sequence opt1 from hemagglutinin__InfluenzaA__AFN18374

SEQ ID NO: 70300 - RNA, 1701 nt, Artificial Sequence
  derived and/or modified sequence opt1 from hemagglutinin__InfluenzaA__AFN18381
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccuggugaagcccggggacaagaucaccuucgaggcgaccggcaaccucguggucccccgcuacgccuucgccauggagcggaacgccggguccggcaucaucaucagcgacacgcccgugcaggacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70301 - RNA, 1701 nt, Artificial Sequence
  derived and/or modified sequence opt1 from hemagglutinin__InfluenzaA__AFN18390
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagauccgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 70302 - RNA, 1701 nt, Artificial Sequence
  derived and/or modified sequence opt1 from hemagglutinin__InfluenzaA__AFN18400
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucaccccgcugcaccucgggaagugcaacaucgccggcuggauccuggggaaccccgagugcgagagccuguccaaggccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgcggccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgugggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgcgggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggccagcagccuggugcucgucgugucccugggggcgaucagcuucuggaugugcuccaacggcagccugcagugccggaucugcaucuga

SEQ ID NO: 70303 - RNA, 1701 nt, Artificial Sequence; identical to SEQ ID NO: 63768
  derived and/or modified sequence opt1 from hemagglutinin__InfluenzaA__AFN18410

SEQ ID NO: 70304 - RNA, 1701 nt, Artificial Sequence; identical to SEQ ID NO: 63677
  derived and/or modified sequence opt1 from hemagglutinin__InfluenzaA__AFN18420

SEQ ID NO: 70305 - RNA, 1701 nt, Artificial Sequence
  derived and/or modified sequence opt1 from hemagglutinin__InfluenzaA__AFN18430
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70306 - RNA, 1701 nt, Artificial Sequence; identical to SEQ ID NO: 63677
  derived and/or modified sequence opt1 from hemagglutinin__InfluenzaA__AFN18440

SEQ ID NO: 70307 - RNA, 1701 nt, Artificial Sequence; identical to SEQ ID NO: 63677
  derived and/or modified sequence opt1 from hemagglutinin__InfluenzaA__AFN18450

SEQ ID NO: 70308 - RNA, 1701 nt, Artificial Sequence; identical to SEQ ID NO: 66232
  derived and/or modified sequence opt1 from hemagglutinin__InfluenzaA__AFN18460

SEQ ID NO: 70309 - RNA, 1701 nt, Artificial Sequence; identical to SEQ ID NO: 64538
  derived and/or modified sequence opt1 from hemagglutinin__InfluenzaA__AFN18470

SEQ ID NO: 70310 - RNA, 1701 nt, Artificial Sequence; identical to SEQ ID NO: 63768
  derived and/or modified sequence opt1 from hemagglutinin__InfluenzaA__AFN18480

SEQ ID NO: 70311 - RNA, 1701 nt, Artificial Sequence; identical to SEQ ID NO: 64538
  derived and/or modified sequence opt1 from hemagglutinin__InfluenzaA__AFN18490

SEQ ID NO: 70312 - RNA, 1701 nt, Artificial Sequence; identical to SEQ ID NO: 63677
  derived and/or modified sequence opt1 from hemagglutinin__InfluenzaA__AFN18497

SEQ ID NO: 70313 - RNA, 1701 nt, Artificial Sequence; identical to SEQ ID NO: 63677
  derived and/or modified sequence opt1 from hemagglutinin__InfluenzaA__AFN18512

SEQ ID NO: 70314 - RNA, 1701 nt, Artificial Sequence
  derived and/or modified sequence opt1 from hemagglutinin__InfluenzaA__AFN18519
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggagaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 70315 - RNA, 1701 nt, Artificial Sequence
  derived and/or modified sequence opt1 from hemagglutinin__InfluenzaA__AFN18521
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccggcgaggccaagcugaaccgggaggagaucgacggggucaagcucgagagcacccgcaucuaccagauccuggcgaucuacuccaccguggccagcagccuggugcucgucgugucccugggcgccaucagcuucuggaugugcuccaacggcagccugcagugccggaucugcaucuga

SEQ ID NO: 70316 - RNA, 1701 nt, Artificial Sequence; identical to SEQ ID NO: 63677
  derived and/or modified sequence opt1 from hemagglutinin__InfluenzaA__AFN18528

SEQ ID NO: 70317 - RNA, 1701 nt, Artificial Sequence; identical to SEQ ID NO: 63677
  derived and/or modified sequence opt1 from hemagglutinin__InfluenzaA__AFN18531

SEQ ID NO: 70318 - RNA, 1701 nt, Artificial Sequence; identical to SEQ ID NO: 66274
  derived and/or modified sequence opt1 from hemagglutinin__InfluenzaA__AFN18543

SEQ ID NO: 70319 - RNA, 1701 nt, Artificial Sequence; identical to SEQ ID NO: 68559
  derived and/or modified sequence opt1 from hemagglutinin__InfluenzaA__AFN18545

SEQ ID NO: 70320 - RNA, 1701 nt, Artificial Sequence; identical to SEQ ID NO: 64538
  derived and/or modified sequence opt1 from hemagglutinin__InfluenzaA__AFN18550

SEQ ID NO: 70321 - RNA, 1701 nt, Artificial Sequence
  derived and/or modified sequence opt1 from hemagglutinin__InfluenzaA__AFN18557
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 70322 - RNA, 1701 nt, Artificial Sequence
  derived and/or modified sequence opt1 from hemagglutinin__InfluenzaA__AFN18559
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagaaccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 70323 - RNA, 1701 nt, Artificial Sequence; identical to SEQ ID NO: 64543
  derived and/or modified sequence opt1 from hemagglutinin__InfluenzaA__AFN18561

SEQ ID NO: 70324 - RNA, 1701 nt, Artificial Sequence; identical to SEQ ID NO: 64779
  derived and/or modified sequence opt1 from hemagglutinin__InfluenzaA__AFN18563

SEQ ID NO: 70325 - RNA, 1701 nt, Artificial Sequence
  derived and/or modified sequence opt1 from hemagglutinin__InfluenzaA__AFN18565
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcauggagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70326 - RNA, 1701 nt, Artificial Sequence
  derived and/or modified sequence opt1 from hemagglutinin__InfluenzaA__AFN18570
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgugagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 70327 - RNA, 1701 nt, Artificial Sequence; identical to SEQ ID NO: 63677
  derived and/or modified sequence opt1 from hemagglutinin__InfluenzaA__AFN18580

SEQ ID NO: 70328 - RNA, 1701 nt, Artificial Sequence; identical to SEQ ID NO: 63919
  derived and/or modified sequence opt1 from hemagglutinin__InfluenzaA__AFN18590

SEQ ID NO: 70329 - RNA, 1701 nt, Artificial Sequence
  derived and/or modified sequence opt1 from hemagglutinin__InfluenzaA__AFN18600
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagaaccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacgccugcauggaguccgugaagaacgggaccuacgacuaccccaaguacagcgaggaggcgaagcugaaccgggaggagaucgacggcgugaagcucgaguccacgcgcaucuaccagauccuggccaucuacagcaccgucgccuccagccuggugcucguggucagccugggggccaucuccuucuggaugugcagcaacggcucccugcagugccggaucugcaucuga

SEQ ID NO: 70330 - RNA, 1701 nt, Artificial Sequence; identical to SEQ ID NO: 63677
  derived and/or modified sequence opt1 from hemagglutinin__InfluenzaA__AFN18610

SEQ ID NO: 70331 - RNA, 1701 nt, Artificial Sequence
  derived and/or modified sequence opt1 from hemagglutinin__InfluenzaA__AFN18617
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaguccgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaagcgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 70332 - RNA, 1701 nt, Artificial Sequence; identical to SEQ ID NO: 64538
  derived and/or modified sequence opt1 from hemagglutinin__InfluenzaA__AFN18622

SEQ ID NO: 70333 - RNA, 1701 nt, Artificial Sequence; identical to SEQ ID NO: 63677
  derived and/or modified sequence opt1 from hemagglutinin__InfluenzaA__AFN18629

SEQ ID NO: 70334 - RNA, 1701 nt, Artificial Sequence; identical to SEQ ID NO: 63919
  derived and/or modified sequence opt1 from hemagglutinin__InfluenzaA__AFN18634

SEQ ID NO: 70335 - RNA, 1701 nt, Artificial Sequence
  derived and/or modified sequence opt1 from hemagglutinin__InfluenzaA__AFN18644
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaguccgcgaucgacgagaucaccaacaaggucaacagcgugaucgagaaggucaacacccaguucacggccgugggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 70336 - RNA, 1701 nt, Artificial Sequence; identical to SEQ ID NO: 64538
  derived and/or modified sequence opt1 from hemagglutinin__InfluenzaA__AFN18654

SEQ ID NO: 70337 - RNA, 1701 nt, Artificial Sequence; identical to SEQ ID NO: 63677
  derived and/or modified sequence opt1 from hemagglutinin__InfluenzaA__AFN18664

SEQ ID NO: 70338 - RNA, 1701 nt, Artificial Sequence; identical to SEQ ID NO: 63919
  derived and/or modified sequence opt1 from hemagglutinin__InfluenzaA__AFN18674

SEQ ID NO: 70339 - RNA, 1701 nt, Artificial Sequence; identical to SEQ ID NO: 63677
  derived and/or modified sequence opt1 from hemagglutinin__InfluenzaA__AFN18684

SEQ ID NO: 70340 - RNA, 1701 nt, Artificial Sequence; identical to SEQ ID NO: 64538
  derived and/or modified sequence opt1 from hemagglutinin__InfluenzaA__AFN18694

SEQ ID NO: 70341 - RNA, 1701 nt, Artificial Sequence
  derived and/or modified sequence opt1 from hemagglutinin__InfluenzaA__AFN18704
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaguccgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 70342 - RNA, 1701 nt, Artificial Sequence; identical to SEQ ID NO: 65911
  derived and/or modified sequence opt1 from hemagglutinin__InfluenzaA__AFN18714

SEQ ID NO: 70343 - RNA, 1701 nt, Artificial Sequence; identical to SEQ ID NO: 63677
  derived and/or modified sequence opt1 from hemagglutinin__InfluenzaA__AFN18721

SEQ ID NO: 70344 - RNA, 1701 nt, Artificial Sequence; identical to SEQ ID NO: 66343
  derived and/or modified sequence opt1 from hemagglutinin__InfluenzaA__AFN18725

SEQ ID NO: 70345 - RNA, 1701 nt, Artificial Sequence
  derived and/or modified sequence opt1 from hemagglutinin__InfluenzaA__AFN18735
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagacccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70346 - RNA, 1701 nt, Artificial Sequence; identical to SEQ ID NO: 63677
  derived and/or modified sequence opt1 from hemagglutinin__InfluenzaA__AFN18742

SEQ ID NO: 70347 - RNA, 1701 nt, Artificial Sequence; identical to SEQ ID NO: 64779
  derived and/or modified sequence opt1 from hemagglutinin__InfluenzaA__AFN18747

SEQ ID NO: 70348 - RNA, 1701 nt, Artificial Sequence
  derived and/or modified sequence opt1 from hemagglutinin__InfluenzaA__AFN18757
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucgccgugccccgguacgccuucgccauggagcgcaacgccggguccggcaucaucaucagcgacacgcccguccacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcagccugguccucguggugucccugggggccaucagcuucuggaugugcuccaacggcagccugcagugccggaucugcaucuga

SEQ ID NO: 70349 - RNA, 1701 nt, Artificial Sequence; identical to SEQ ID NO: 63677
  derived and/or modified sequence opt1 from hemagglutinin__InfluenzaA__AFN18767

SEQ ID NO: 70350 - RNA, 1701 nt, Artificial Sequence; identical to SEQ ID NO: 70341
  derived and/or modified sequence opt1 from hemagglutinin__InfluenzaA__AFN18774

SEQ ID NO: 70351 - RNA, 1701 nt, Artificial Sequence; identical to SEQ ID NO: 63677
  derived and/or modified sequence opt1 from hemagglutinin__InfluenzaA__AFN18776

SEQ ID NO: 70352 - RNA, 1701 nt, Artificial Sequence; identical to SEQ ID NO: 64543
  derived and/or modified sequence opt1 from hemagglutinin__InfluenzaA__AFN18778

SEQ ID NO: 70353 - RNA, 1701 nt, Artificial Sequence; identical to SEQ ID NO: 63677
  derived and/or modified sequence opt1 from hemagglutinin__InfluenzaA__AFN18784

SEQ ID NO: 70354 - RNA, 1701 nt, Artificial Sequence; identical to SEQ ID NO: 64543
  derived and/or modified sequence opt1 from hemagglutinin__InfluenzaA__AFN18789

SEQ ID NO: 70355 - RNA, 1701 nt, Artificial Sequence; identical to SEQ ID NO: 63677
  derived and/or modified sequence opt1 from hemagglutinin__InfluenzaA__AFN18799

SEQ ID NO: 70356 - RNA, 1701 nt, Artificial Sequence; identical to SEQ ID NO: 63677
  derived and/or modified sequence opt1 from hemagglutinin__InfluenzaA__AFN18809

SEQ ID NO: 70357 - RNA, 1701 nt, Artificial Sequence; identical to SEQ ID NO: 64779
  derived and/or modified sequence opt1 from hemagglutinin__InfluenzaA__AFN18816

SEQ ID NO: 70358 - RNA, 1701 nt, Artificial Sequence; identical to SEQ ID NO: 63677
  derived and/or modified sequence opt1 from hemagglutinin__InfluenzaA__AFN18818

SEQ ID NO: 70359 - RNA, 1701 nt, Artificial Sequence
  derived and/or modified sequence opt1 from hemagglutinin__InfluenzaA__AFN18820
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70360 - RNA, 1701 nt, Artificial Sequence; identical to SEQ ID NO: 63677
  derived and/or modified sequence opt1 from hemagglutinin__InfluenzaA__AFN18822

SEQ ID NO: 70361 - RNA, 1701 nt, Artificial Sequence
  derived and/or modified sequence opt1 from hemagglutinin__InfluenzaA__AFN18824
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugcgccucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70362 - RNA, 1701 nt, Artificial Sequence; identical to SEQ ID NO: 70285
  derived and/or modified sequence opt1 from hemagglutinin__InfluenzaA__AFN18826

SEQ ID NO: 70363 - RNA, 1701 nt, Artificial Sequence
  derived and/or modified sequence opt1 from hemagglutinin__InfluenzaA__AFN18828
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaucaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70364 - RNA, 1701 nt, Artificial Sequence; identical to SEQ ID NO: 70348
  derived and/or modified sequence opt1 from hemagglutinin__InfluenzaA__AFN18830

SEQ ID NO: 70365 - RNA, 1701 nt, Artificial Sequence; identical to SEQ ID NO: 63677
  derived and/or modified sequence opt1 from hemagglutinin__InfluenzaA__AFN18832

SEQ ID NO: 70366 - RNA, 1701 nt, Artificial Sequence; identical to SEQ ID NO: 64543
  derived and/or modified sequence opt1 from hemagglutinin__InfluenzaA__AFN18834

SEQ ID NO: 70367 - RNA, 1701 nt, Artificial Sequence
  derived and/or modified sequence opt1 from hemagglutinin__InfluenzaA__AFN18849
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacguggacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcagccuggugcucgucgugucccugggggccaucagcuucuggaugugcuccaacggcagccugcagugccggaucugcaucuga

SEQ ID NO: 70368 - RNA, 1701 nt, Artificial Sequence
  derived and/or modified sequence opt1 from hemagglutinin__InfluenzaA__AFN18856
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggagaacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70369 - RNA, 1701 nt, Artificial Sequence; identical to SEQ ID NO: 64538
  derived and/or modified sequence opt1 from hemagglutinin__InfluenzaA__AFN18858

SEQ ID NO: 70370 - RNA, 1701 nt, Artificial Sequence
  derived and/or modified sequence opt1 from hemagglutinin__InfluenzaA__AFN18860
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgccccaagguccgggaccaggagggccgcauggacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 70371 - RNA, 1701 nt, Artificial Sequence
  derived and/or modified sequence opt1 from hemagglutinin__InfluenzaA__AFN18865
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacguccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 70372 - RNA, 1701 nt, Artificial Sequence
  derived and/or modified sequence opt1 from hemagglutinin__InfluenzaA__AFN18875
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgcccagcagagccuguaccagaacgccgacgccuacguguucgugggcuccagccgguacuccaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccgggagcggcaucaucaucuccgacacccccgugcacgacugcaacacgaccugccagaccccgaagggcgcgaucaacaccagccugcccuuccacaacauccaccccaucacgaucgggaagugccccaaguacgugaaguccaccaagcugcggcucgccaccggccugcgcaacgucccgagcauccagucccgggggcuguucggcgccaucgccggguucaucgagggcggcuggaccgggaugguggacggcugguacggguaccaccaccagaacgagcagggcagcggguacgccgcggaccucaaguccacgcagaacgccaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 70373 - RNA, 1701 nt, Artificial Sequence
  derived and/or modified sequence opt1 from hemagglutinin__InfluenzaA__AFN18885
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccaaccugcccuuccagaacauccaccccaucaccaucgggaagugccccaaguacgugaaguccaccaagcugcggcucgcgaccggccugcgcaacgugccgagcacgcagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacgagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugcaagaucugcaucuga

SEQ ID NO: 70374 - RNA, 1701 nt, Artificial Sequence; identical to SEQ ID NO: 63677
  derived and/or modified sequence opt1 from hemagglutinin__InfluenzaA__AFN18892

SEQ ID NO: 70375 - RNA, 1701 nt, Artificial Sequence; identical to SEQ ID NO: 63919
  derived and/or modified sequence opt1 from hemagglutinin__InfluenzaA__AFN18894

SEQ ID NO: 70376 - RNA, 1701 nt, Artificial Sequence; identical to SEQ ID NO: 70341
  derived and/or modified sequence opt1 from hemagglutinin__InfluenzaA__AFN18903

SEQ ID NO: 70377 - RNA, 1701 nt, Artificial Sequence; identical to SEQ ID NO: 64779
  derived and/or modified sequence opt1 from hemagglutinin__InfluenzaA__AFN18910

SEQ ID NO: 70378 - RNA, 1701 nt, Artificial Sequence
  derived and/or modified sequence opt1 from hemagglutinin__InfluenzaA__AFN18912
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacaccagcgugcacgacugcaacacgaccugccagacccccaagggcgccaucaacaccucccugccguuccacaacauccaccccaucacgaucgggaagugccccaaguacgucaagagcaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 70379 - RNA, 1701 nt, Artificial Sequence; identical to SEQ ID NO: 64779
  derived and/or modified sequence opt1 from hemagglutinin__InfluenzaA__AFN18917

SEQ ID NO: 70380 - RNA, 1701 nt, Artificial Sequence; identical to SEQ ID NO: 63677
  derived and/or modified sequence opt1 from hemagglutinin__InfluenzaA__AFN18927

SEQ ID NO: 70381 - RNA, 1701 nt, Artificial Sequence; identical to SEQ ID NO: 66343
  derived and/or modified sequence opt1 from hemagglutinin__InfluenzaA__AFN18937

SEQ ID NO: 70382 - RNA, 1701 nt, Artificial Sequence
  derived and/or modified sequence opt1 from hemagglutinin__InfluenzaA__AFN18952
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaaccgcaagcugugcaagcuccgcggggucgcgccccugcaccugggcaagugcaacaucgccggguggauccucggcaacccggagugcgagagccuguccaccgccagcuccuggagcuacaucguggagaccuccagcuccgacaacgggacgugcuaccccggcgacuucaucgacuacgaggagcugcgggagcagcucagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcuggugaagaagggcaacagcuaccccaagcucuccaagagcuacaucaacgacaaggggaaggaggugcugguccuguggggcauccaccaccccagcaccuccgccgaccagcagagccucuaccagaacgccgacgccuacguguucguggggacgucccgcuacagcaagaaguucaagcccgagaucgccauccggccgaagguccgcgaccaggagggccggaugaacuacuacuggacccugguggagcccggcgacaagaucaccuucgaggcgaccgggaaccugguggucccccgcuacgccuucgccauggagcggaacgccggcuccgggaucaucaucagcgacacgcccgugcacgacugcaacacgaccugccagaccccgaagggcgccaucaacaccucccuccccuuccagaacauccaccccaucaccaucggcaagugccccaaguacgucaagagcaccaagcugcgccuggcgaccgggcuccggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgcgagaagaucgacggggugaagcuggagagcacccggaucuaccagauccucgcgaucuacuccaccgucgccagcagccuggugcugguggucucccucggcgccaucagcuucuggaugugcuccaacgggagccugcagugccgcaucugcaucuga

SEQ ID NO: 70383 - RNA, 1701 nt, Artificial Sequence
  derived and/or modified sequence opt1 from hemagglutinin__InfluenzaA__AFN18957
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70384 - RNA, 1701 nt, Artificial Sequence; identical to SEQ ID NO: 69766
  derived and/or modified sequence opt1 from hemagglutinin__InfluenzaA__AFN18964

SEQ ID NO: 70385 - RNA, 1701 nt, Artificial Sequence
  derived and/or modified sequence opt1 from hemagglutinin__InfluenzaA__AFN18974
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccaugagcuccuucgagcgcuucgagaucuuccccaagaccagcuccuggcccaaccacgacccgaacaagggggugaccgccgccugcccccacgccggcgccaagagcuucuacaagaaccugaucuggcucgucaagaaggggaacuccuaccccaagcugagcaaguccuacaucaacgacaagggcaagaaggugcuggugcucugggggauccaccaccccagcaccagcgccgaccagcagucccuguaccagaacgccgacgccuacgucuucgugggcacgagccgguacuccaagaaguucaagccggagaucgccauccgccccaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgccgguccacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacgugcccagcauccagucccgggggcuguucggcgccaucgccggguucaucgagggcggcuggacggggauggucgacggcugguacggguaccaccaccagaacgagcagggcagcggguacgccgccgaccucaaguccacccagaacgcgaucgacgagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgacgaggccaagcugaaccgggaggagaucgacggcgugaagcucgaguccacccgcaucuaccagauccuggcgaucuacagcaccguggccuccagccugguccucguggugagccugggggccaucuccuucuggaugugcagcaacggcucccugcagugccggaucugcaucuga

SEQ ID NO: 70386 - RNA, 1701 nt, Artificial Sequence; identical to SEQ ID NO: 65229
  derived and/or modified sequence opt1 from hemagglutinin__InfluenzaA__AFN18979

SEQ ID NO: 70387 - RNA, 1701 nt, Artificial Sequence
  derived and/or modified sequence opt1 from hemagglutinin__InfluenzaA__AFN18982
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgaacagcuggcccaaccacgacuccaacaagggcgucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcaccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagcacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucaacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 70388 - RNA, 1701 nt, Artificial Sequence; identical to SEQ ID NO: 70280
  derived and/or modified sequence opt1 from hemagglutinin__InfluenzaA__AFN18984

SEQ ID NO: 70389 - RNA, 1701 nt, Artificial Sequence; identical to SEQ ID NO: 63677
  derived and/or modified sequence opt1 from hemagglutinin__InfluenzaA__AFN18986

SEQ ID NO: 70390 - RNA, 1701 nt, Artificial Sequence; identical to SEQ ID NO: 63677
  derived and/or modified sequence opt1 from hemagglutinin__InfluenzaA__AFN18988

SEQ ID NO: 70391 - RNA, 1701 nt, Artificial Sequence; identical to SEQ ID NO: 64841
  derived and/or modified sequence opt1 from hemagglutinin__InfluenzaA__AFN18993

SEQ ID NO: 70392 - RNA, 1701 nt, Artificial Sequence; identical to SEQ ID NO: 64841
  derived and/or modified sequence opt1 from hemagglutinin__InfluenzaA__AFN18999

SEQ ID NO: 70393 - RNA, 1701 nt, Artificial Sequence; identical to SEQ ID NO: 64475
  derived and/or modified sequence opt1 from hemagglutinin__InfluenzaA__AFN19006

SEQ ID NO: 70394 - RNA, 1701 nt, Artificial Sequence; identical to SEQ ID NO: 63677
  derived and/or modified sequence opt1 from hemagglutinin__InfluenzaA__AFN19026

SEQ ID NO: 70395 - RNA, 1701 nt, Artificial Sequence; identical to SEQ ID NO: 64817
  derived and/or modified sequence opt1 from hemagglutinin__InfluenzaA__AFN19036

SEQ ID NO: 70396 - RNA, 1701 nt, Artificial Sequence; identical to SEQ ID NO: 63677
  derived and/or modified sequence opt1 from hemagglutinin__InfluenzaA__AFN19043

SEQ ID NO: 70397 - RNA, 1701 nt, Artificial Sequence; identical to SEQ ID NO: 63677
  derived and/or modified sequence opt1 from hemagglutinin__InfluenzaA__AFN19053

SEQ ID NO: 70398 - RNA, 1701 nt, Artificial Sequence; identical to SEQ ID NO: 63677
  derived and/or modified sequence opt1 from hemagglutinin__InfluenzaA__AFN19063

SEQ ID NO: 70399 - RNA, 1701 nt, Artificial Sequence; identical to SEQ ID NO: 63677
  derived and/or modified sequence opt1 from hemagglutinin__InfluenzaA__AFN19070

SEQ ID NO: 70400 - RNA, 1701 nt, Artificial Sequence
  derived and/or modified sequence opt1 from hemagglutinin__InfluenzaA__AFN19076
augaaggccauccuggugguccuccuguacaccuucgccaccgcgaacgccgacacgcugugcaucggcuaccacgccaacaacagcaccgacaccguggacaccgugcucgagaaggacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70401 - RNA, 1701 nt, Artificial Sequence; identical to SEQ ID NO: 63677
  derived and/or modified sequence opt1 from hemagglutinin__InfluenzaA__AFN19082

SEQ ID NO: 70402 - RNA, 1701 nt, Artificial Sequence; identical to SEQ ID NO: 63677
  derived and/or modified sequence opt1 from hemagglutinin__InfluenzaA__AFN19088

SEQ ID NO: 70403 - RNA, 1701 nt, Artificial Sequence; identical to SEQ ID NO: 63677
  derived and/or modified sequence opt1 from hemagglutinin__InfluenzaA__AFN19097

SEQ ID NO: 70404 - RNA, 1701 nt, Artificial Sequence; identical to SEQ ID NO: 63677
  derived and/or modified sequence opt1 from hemagglutinin__InfluenzaA__AFN19104

SEQ ID NO: 70405 - RNA, 1701 nt, Artificial Sequence; identical to SEQ ID NO: 63677
  derived and/or modified sequence opt1 from hemagglutinin__InfluenzaA__AFN19113

SEQ ID NO: 70406 - RNA, 1701 nt, Artificial Sequence; identical to SEQ ID NO: 63677
  derived and/or modified sequence opt1 from hemagglutinin__InfluenzaA__AFN19119

SEQ ID NO: 70407 - RNA, 1701 nt, Artificial Sequence; identical to SEQ ID NO: 66188
  derived and/or modified sequence opt1 from hemagglutinin__InfluenzaA__AFN19125

SEQ ID NO: 70408 - RNA, 1701 nt, Artificial Sequence; identical to SEQ ID NO: 63677
  derived and/or modified sequence opt1 from hemagglutinin__InfluenzaA__AFN19134

SEQ ID NO: 70409 - RNA, 1701 nt, Artificial Sequence; identical to SEQ ID NO: 63677
  derived and/or modified sequence opt1 from hemagglutinin__InfluenzaA__AFN19144

SEQ ID NO: 70410 - RNA, 1701 nt, Artificial Sequence; identical to SEQ ID NO: 66232
  derived and/or modified sequence opt1 from hemagglutinin__InfluenzaA__AFN19154

SEQ ID NO: 70411 - RNA, 1701 nt, Artificial Sequence; identical to SEQ ID NO: 63677
  derived and/or modified sequence opt1 from hemagglutinin__InfluenzaA__AFN19164

SEQ ID NO: 70412 - RNA, 1701 nt, Artificial Sequence; identical to SEQ ID NO: 63677
  derived and/or modified sequence opt1 from hemagglutinin__InfluenzaA__AFN19174

SEQ ID NO: 70413 - RNA, 1701 nt, Artificial Sequence; identical to SEQ ID NO: 63677
  derived and/or modified sequence opt1 from hemagglutinin__InfluenzaA__AFN19184

SEQ ID NO: 70414 - RNA, 1701 nt, Artificial Sequence; identical to SEQ ID NO: 63677
  derived and/or modified sequence opt1 from hemagglutinin__InfluenzaA__AFN19194

SEQ ID NO: 70415 - RNA, 1701 nt, Artificial Sequence; identical to SEQ ID NO: 63677
  derived and/or modified sequence opt1 from hemagglutinin__InfluenzaA__AFN19203

SEQ ID NO: 70416 - RNA, 1701 nt, Artificial Sequence; identical to SEQ ID NO: 63677
  derived and/or modified sequence opt1 from hemagglutinin__InfluenzaA__AFN19213

SEQ ID NO: 70417 - RNA, 1701 nt, Artificial Sequence; identical to SEQ ID NO: 63677
  derived and/or modified sequence opt1 from hemagglutinin__InfluenzaA__AFN19223

SEQ ID NO: 70418 - RNA, 1701 nt, Artificial Sequence; identical to SEQ ID NO: 63677
  derived and/or modified sequence opt1 from hemagglutinin__InfluenzaA__AFN19233

SEQ ID NO: 70419 - RNA, 1701 nt, Artificial Sequence
  derived and/or modified sequence opt1 from hemagglutinin__InfluenzaA__AFN19243
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcaggacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70420 - RNA, 1701 nt, Artificial Sequence; identical to SEQ ID NO: 65793
  derived and/or modified sequence opt1 from hemagglutinin__InfluenzaA__AFN19250

SEQ ID NO: 70421 - RNA, 1701 nt, Artificial Sequence; identical to SEQ ID NO: 63677
  derived and/or modified sequence opt1 from hemagglutinin__InfluenzaA__AFN19259

SEQ ID NO: 70422 - RNA, 1701 nt, Artificial Sequence; identical to SEQ ID NO: 63677
  derived and/or modified sequence opt1 from hemagglutinin__InfluenzaA__AFN19269

SEQ ID NO: 70423 - RNA, 1701 nt, Artificial Sequence; identical to SEQ ID NO: 63677
  derived and/or modified sequence opt1 from hemagglutinin__InfluenzaA__AFN19279

SEQ ID NO: 70424 - RNA, 1701 nt, Artificial Sequence; identical to SEQ ID NO: 64538
  derived and/or modified sequence opt1 from hemagglutinin__InfluenzaA__AFN19286

SEQ ID NO: 70425 - RNA, 1701 nt, Artificial Sequence; identical to SEQ ID NO: 63677
  derived and/or modified sequence opt1 from hemagglutinin__InfluenzaA__AFN19295

SEQ ID NO: 70426 - RNA, 1701 nt, Artificial Sequence; identical to SEQ ID NO: 63677
  derived and/or modified sequence opt1 from hemagglutinin__InfluenzaA__AFN19305

SEQ ID NO: 70427 - RNA, 1701 nt, Artificial Sequence; identical to SEQ ID NO: 64543
  derived and/or modified sequence opt1 from hemagglutinin__InfluenzaA__AFN19315

SEQ ID NO: 70428 - RNA, 1701 nt, Artificial Sequence; identical to SEQ ID NO: 63677
  derived and/or modified sequence opt1 from hemagglutinin__InfluenzaA__AFN19325

SEQ ID NO: 70429 - RNA, 1701 nt, Artificial Sequence; identical to SEQ ID NO: 63677
  derived and/or modified sequence opt1 from hemagglutinin__InfluenzaA__AFN19335

SEQ ID NO: 70430 - RNA, 1701 nt, Artificial Sequence; identical to SEQ ID NO: 63677
  derived and/or modified sequence opt1 from hemagglutinin__InfluenzaA__AFN19344

SEQ ID NO: 70431 - RNA, 1701 nt, Artificial Sequence
  derived and/or modified sequence opt1 from hemagglutinin__InfluenzaA__AFN19351
augaagaccaucaucgcccugagcuacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggaccggggugacgcagaacggcaccagcuccgccugcauccgccggagcaacaacuccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcgggcggaucaccguguccaccaagcgcagccagcaggccgugaucccgaacaucggcagccggccccgcauccggaacauccccucccgcaucagcaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacccugaagcucgcgacgggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacgugcggugcaacaucugcaucuga

SEQ ID NO: 70432 - RNA, 1701 nt, Artificial Sequence; identical to SEQ ID NO: 70082
  derived and/or modified sequence opt1 from hemagglutinin__InfluenzaA__AFN19355

SEQ ID NO: 70433 - RNA, 1701 nt, Artificial Sequence; identical to SEQ ID NO: 70082
  derived and/or modified sequence opt1 from hemagglutinin__InfluenzaA__AFN19357

SEQ ID NO: 70434 - RNA, 1701 nt, Artificial Sequence; identical to SEQ ID NO: 70082
  derived and/or modified sequence opt1 from hemagglutinin__InfluenzaA__AFN19361

SEQ ID NO: 70435 - RNA, 1701 nt, Artificial Sequence
  derived and/or modified sequence opt1 from hemagglutinin__InfluenzaA__AFN19363
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacuccagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugagcacgaagcgcagccagcaggccgugaucccgaacaucggcucccggccccgcauccggaacauccccagccgcaucuccaucuacuggaccaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70436 - RNA, 1701 nt, Artificial Sequence; identical to SEQ ID NO: 67990
  derived and/or modified sequence opt1 from hemagglutinin__InfluenzaA__AFN19365

SEQ ID NO: 70437 - RNA, 1701 nt, Artificial Sequence
  derived and/or modified sequence opt1 from hemagglutinin__InfluenzaA__AFN19367
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggugaacugcacccugaucgacgcccugcucggcgacccccagugcgacggguuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugagcacgaagcgcucccagcaggccgucaucccgaacaucgggagccggccccgcauccggaacauccccucccgcaucagcaucuacuggaccaucgugaagcccggcgacauccugcucaucaacuccaccggcaaccugaucgccccgcggggguacuucaagauccagagcggcaaguccagcaucaugcgcuccgacgcccccaucgggaagugcaacagcgagugcaucacccccaacggcuccauccccaacgacaagccguuccagaacgugaaccggaucacguacggcgccugcccccgcuacgucaagcagagcacccugaagcucgcgaccgggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccugaaguccacgcaggcggccaucgaccagaucaacggcaagcugaaccggcucaucgggaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacaugggcaacgggugcuucaagaucuaccacaagugcgacaacgcgugcaucggcagcauccgcaacgggaccuacaaccacgacgucuaccgcgacgaggcccucaacaaccgguuccagaucaagggcguggagcugaaguccggguacaaggacuggauccuguggaucagcuucgccaucagcugcuuccuccugugcguggcccugcucggcuucaucaugugggccugccagaagggcaacauccgcugcaacaucugcaucuga

SEQ ID NO: 70438 - RNA, 1701 nt, Artificial Sequence
  derived and/or modified sequence opt1 from hemagglutinin__InfluenzaA__AFN19369
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggugaacugcacccugaucgacgcccugcucggcgacccccagugcgacggguuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugagcacgaagcgcucccagcaggccgucaucccgaacaucgggagccggccccgcauccggaacauccccucccgcaucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgagugcaucacccccaacggcuccauccccaacgacaagccguuccagaacgugaaccgcaucacguacggcgccugcccccgguacgucaagcagagcacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacaaccacgacgucuaccgggacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 70439 - RNA, 1701 nt, Artificial Sequence
  derived and/or modified sequence opt1 from hemagglutinin__InfluenzaA__AFN19373
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacaacuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcagccagcaggccgugaucccgaacaucggcagccggccccgcauccggaacauccccucccgcaucagcaucuacuggacgaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70440 - RNA, 1701 nt, Artificial Sequence; identical to SEQ ID NO: 70082
  derived and/or modified sequence opt1 from hemagglutinin__InfluenzaA__AFN19375

SEQ ID NO: 70441 - RNA, 1701 nt, Artificial Sequence
  derived and/or modified sequence opt1 from hemagglutinin__InfluenzaA__AFN19377
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggugaacugcacccugaucgacgcccugcucggcgacccccagugcgacggguuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugagcacgaagcgcucccagcaggccgucaucccgaacaucgggagccggccccgcauccggaacauccccucccgcaucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgagugcaucacccccaacggcuccauccccaacgacaagccguuccagaacgugaaccgcaucacguacggcgccugcccccgguacgucaagcagagcacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacaaccacgacgucuaccgggacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaacggcaacauccggugcaacaucugcaucuga

SEQ ID NO: 70442 - RNA, 1701 nt, Artificial Sequence; identical to SEQ ID NO: 70082
  derived and/or modified sequence opt1 from hemagglutinin__InfluenzaA__AFN19379

SEQ ID NO: 70443 - RNA, 1701 nt, Artificial Sequence; identical to SEQ ID NO: 70439
  derived and/or modified sequence opt1 from hemagglutinin__InfluenzaA__AFN19381

SEQ ID NO: 70444 - RNA, 1701 nt, Artificial Sequence; identical to SEQ ID NO: 70438
  derived and/or modified sequence opt1 from hemagglutinin__InfluenzaA__AFN19383

SEQ ID NO: 70445 - RNA, 1701 nt, Artificial Sequence
  derived and/or modified sequence opt1 from hemagglutinin__InfluenzaA__AFN19385
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggugaacugcacccugaucgacgcccugcucggcgacccccagugcgacggguuccagaacaagaagugggaccuguucguggagcgcuccaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugagcacgaagcgcucccagcaggccgucaucccgaacaucgggagccggccccgcauccggaacauccccucccgcaucagcaucuacuggaccaucgugaagcccggcgacauccugcucaucaacuccaccggcaaccugaucgccccgcggggguacuucaagauccagagcggcaaguccagcaucaugcgcuccgacgcccccaucgggaagugcaacagcgagugcaucacccccaacggcuccauccccaacgacaagccguuccagaacgugaaccggaucacguacggcgccugcccccgcuacgucaagcagagcacccugaagcucgcgaccgggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacgcaggcggccaucgaccagaucaacggcaagcugaaccggcucaucgggaagaccaacgagaaguuccaccagaucgagaaggaguucuccgaggucgagggccgcauccaggaccuggagaaguacguggaggacaccaagaucgacaucuggagcuacaacgccgagcugcucguggcccuggagaaccagcacaccaucgaccugacggacuccgagaugaacaagcuguucgagaagaccaagaagcagcugcgggagaacgccgaggacaugggcaacgggugcuucaagaucuaccacaagugcgacaacgcgugcaucggcagcauccgcaacgggaccuacaaccacgacgucuaccgcgacgaggcccugaacaaccgguuccagaucaagggcguggagcucaaguccggguacaaggacuggauccuguggaucagcuucgccaucagcugcuuccugcucugcguggcccugcugggcuucaucaugugggccugccagaagggcaacauccgcugcaacaucugcaucuga

SEQ ID NO: 70446 - RNA, 1701 nt, Artificial Sequence; identical to SEQ ID NO: 70438
  derived and/or modified sequence opt1 from hemagglutinin__InfluenzaA__AFN19387

SEQ ID NO: 70447 - RNA, 1701 nt, Artificial Sequence; identical to SEQ ID NO: 70082
  derived and/or modified sequence opt1 from hemagglutinin__InfluenzaA__AFN19389

SEQ ID NO: 70448 - RNA, 1701 nt, Artificial Sequence; identical to SEQ ID NO: 70082
  derived and/or modified sequence opt1 from hemagglutinin__InfluenzaA__AFN19391

SEQ ID NO: 70449 - RNA, 1701 nt, Artificial Sequence
  derived and/or modified sequence opt1 from hemagglutinin__InfluenzaA__AFN19393
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccucuccaaccgguuccagaucaagggggucgagcucaagagcggcuacaaggacuggauccuguggaucuccuucgccaucagcugcuuccugcugugcguggcgcugcucggcuucaucaugugggccugccagaaggggaacauccgcugcaacaucugcaucuga

SEQ ID NO: 70450 - RNA, 1701 nt, Artificial Sequence; identical to SEQ ID NO: 70438
  derived and/or modified sequence opt1 from hemagglutinin__InfluenzaA__AFN19397

SEQ ID NO: 70451 - RNA, 1701 nt, Artificial Sequence; identical to SEQ ID NO: 70082
  derived and/or modified sequence opt1 from hemagglutinin__InfluenzaA__AFN19399

SEQ ID NO: 70452 - RNA, 1701 nt, Artificial Sequence; identical to SEQ ID NO: 70438
  derived and/or modified sequence opt1 from hemagglutinin__InfluenzaA__AFN19401

SEQ ID NO: 70453 - RNA, 1701 nt, Artificial Sequence; identical to SEQ ID NO: 70082
  derived and/or modified sequence opt1 from hemagglutinin__InfluenzaA__AFN19403

SEQ ID NO: 70454 - RNA, 1701 nt, Artificial Sequence; identical to SEQ ID NO: 70438
  derived and/or modified sequence opt1 from hemagglutinin__InfluenzaA__AFN19405

SEQ ID NO: 70455 - RNA, 1701 nt, Artificial Sequence
  derived and/or modified sequence opt1 from hemagglutinin__InfluenzaA__AFN19407
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggagcggggugacgcagaacggcaccuccagcgccugcaugcgccgguccaacagcuccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcgggcggaucaccgugagcaccaagcgcucccagcaggccgugaucccgaacaucggcagccggccccgcauccggaacauccccucccgcaucagcaucuacuggaccaucgucaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacccugaagcucgcgacgggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 70456 - RNA, 1701 nt, Artificial Sequence
  derived and/or modified sequence opt1 from hemagglutinin__InfluenzaA__AFN19409
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaucggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacagcuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccgugagcaccaagcgcucccagcaggccgugaucccgaacaucggcagccggccccgcauccggaacauccccucccgcaucagcaucuacuggacgaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 70457 - RNA, 1701 nt, Artificial Sequence; identical to SEQ ID NO: 70438
  derived and/or modified sequence opt1 from hemagglutinin__InfluenzaA__AFN19411

SEQ ID NO: 70458 - RNA, 1701 nt, Artificial Sequence; identical to SEQ ID NO: 70082
  derived and/or modified sequence opt1 from hemagglutinin__InfluenzaA__AFN19413

SEQ ID NO: 70459 - RNA, 1701 nt, Artificial Sequence
  derived and/or modified sequence opt1 from hemagglutinin__InfluenzaA__AFN19415
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcgugaugcgguccgacgcccccaucggcaagugcaacagcgagugcaucacccccaacggcuccauccccaacgacaagccguuccagaacgugaaccgcaucacguacggggccugcccccgguacgucaagcagagcacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 70460 - RNA, 1701 nt, Artificial Sequence
  derived and/or modified sequence opt1 from hemagglutinin__InfluenzaA__AFN19417
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaguccagcgggcggaucaccgucagcacgaagcgcucccagcaggccgugaucccgaacaucggcagccggccccgcauccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgucaaccgcaucacguacggggccugcccccgguacgugaagcagagcacccugaagcucgcgaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 70461 - RNA, 1701 nt, Artificial Sequence
  derived and/or modified sequence opt1 from hemagglutinin__InfluenzaA__AFN19423
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 70462 - RNA, 1701 nt, Artificial Sequence; identical to SEQ ID NO: 70438
  derived and/or modified sequence opt1 from hemagglutinin__InfluenzaA__AFN19425

SEQ ID NO: 70463 - RNA, 1701 nt, Artificial Sequence
  derived and/or modified sequence opt1 from hemagglutinin__InfluenzaA__AFN19437
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuuccgcauccgguccggcaagagcuccaucaugcgcagcgacgcccccaucgggaagugcaacuccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaaccggaagcugaaccgccucaucgggaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacuacguguaccgggacgaggcccucaacaaccgcuuccagaucaagggcgucgagcucaagagcggguacaaggacuggauccuguggaucuccuucgccaucagcugcuuccugcugugcguggcccugcucggcuucaucaugugggccugccagaagggcaacauccggugcaacaucugcaucuga

SEQ ID NO: 70464 - RNA, 1701 nt, Artificial Sequence
  derived and/or modified sequence opt1 from hemagglutinin__InfluenzaA__AFN19439
augaagaccaucaucgcccugagccacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacgggaucaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagccguccggccggaucaccgugagcacgaagcgcagccagcaggccgugauccccaacaucgggucccggccccgcauccggaacauccccagccgcaucuccaucuacuggaccaucgucaagccgggcgacauccugcucaucaacagcaccggcaaccugaucgcgccccggggguacuucaagauccgcuccggcaagagcuccaucaugcggagcgacgcccccaucgggaagugcaacuccgagugcaucacccccaacggcagcaucccgaacgacaagcccuuccagaacgugaaccgcaucacguacggcgccugcccccgguacgugaagcaguccacccugaagcucgccaccgggaugcgcaacguccccgagaagcagacccggggcaucuucggggccaucgccggcuucaucgagaacgggugggagggcaugguggacggcugguacggguuccgccaccagaacagcgagggccgggggcaggccgccgaccugaaguccacgcaggcggccaucgaccagaucaacggcaagcugaaccgccucaucgggaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 70465 - RNA, 1701 nt, Artificial Sequence; identical to SEQ ID NO: 70439
  derived and/or modified sequence opt1 from hemagglutinin__InfluenzaA__AFN19443

SEQ ID NO: 70466 - RNA, 1701 nt, Artificial Sequence
  derived and/or modified sequence opt1 from hemagglutinin__InfluenzaA__AFN19445
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugcggcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70467 - RNA, 1701 nt, Artificial Sequence; identical to SEQ ID NO: 70461
  derived and/or modified sequence opt1 from hemagglutinin__InfluenzaA__AFN19447

SEQ ID NO: 70468 - RNA, 1701 nt, Artificial Sequence
  derived and/or modified sequence opt1 from hemagglutinin__InfluenzaA__AFN19451
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaacggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70469 - RNA, 1701 nt, Artificial Sequence
  derived and/or modified sequence opt1 from hemagglutinin__InfluenzaA__AFN19453
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccaggucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70470 - RNA, 1701 nt, Artificial Sequence; identical to SEQ ID NO: 70461
  derived and/or modified sequence opt1 from hemagglutinin__InfluenzaA__AFN19455

SEQ ID NO: 70471 - RNA, 1701 nt, Artificial Sequence; identical to SEQ ID NO: 70082
  derived and/or modified sequence opt1 from hemagglutinin__InfluenzaA__AFN19457

SEQ ID NO: 70472 - RNA, 1701 nt, Artificial Sequence; identical to SEQ ID NO: 70082
  derived and/or modified sequence opt1 from hemagglutinin__InfluenzaA__AFN19459

SEQ ID NO: 70473 - RNA, 1701 nt, Artificial Sequence; identical to SEQ ID NO: 70439
  derived and/or modified sequence opt1 from hemagglutinin__InfluenzaA__AFN19461

SEQ ID NO: 70474 - RNA, 1701 nt, Artificial Sequence
  derived and/or modified sequence opt1 from hemagglutinin__InfluenzaA__AFN19465
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaucgggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcaucgcccugcucggcuucaucaugugggccugccagaaggggaacauccggugcaacaucugcaucuga

SEQ ID NO: 70475 - RNA, 1701 nt, Artificial Sequence; identical to SEQ ID NO: 70461
  derived and/or modified sequence opt1 from hemagglutinin__InfluenzaA__AFN19467

SEQ ID NO: 70476 - RNA, 1701 nt, Artificial Sequence; identical to SEQ ID NO: 70469
  derived and/or modified sequence opt1 from hemagglutinin__InfluenzaA__AFN19469

SEQ ID NO: 70477 - RNA, 1701 nt, Artificial Sequence; identical to SEQ ID NO: 70082
  derived and/or modified sequence opt1 from hemagglutinin__InfluenzaA__AFN19471

SEQ ID NO: 70478 - RNA, 1701 nt, Artificial Sequence
  derived and/or modified sequence opt1 from hemagglutinin__InfluenzaA__AFN19473
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcggcagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcggccggaucaccgugagcacgaagcgcucccagcaggccgugaucccgaacaucggcagccggccccgcauccggaacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucacguacggcgccugcccccgguacgugaagcagagcacccugaagcucgcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccugaaguccacgcaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcagcauccgcaacgggaccuacaaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 70479 - RNA, 1701 nt, Artificial Sequence; identical to SEQ ID NO: 70461
  derived and/or modified sequence opt1 from hemagglutinin__InfluenzaA__AFN19475

SEQ ID NO: 70480 - RNA, 1701 nt, Artificial Sequence; identical to SEQ ID NO: 70082
  derived and/or modified sequence opt1 from hemagglutinin__InfluenzaA__AFN19477

SEQ ID NO: 70481 - RNA, 1701 nt, Artificial Sequence
  derived and/or modified sequence opt1 from hemagglutinin__InfluenzaA__AFN19479
augaagaccaucaucgcccugagcugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70482 - RNA, 1701 nt, Artificial Sequence; identical to SEQ ID NO: 70461
  derived and/or modified sequence opt1 from hemagglutinin__InfluenzaA__AFN19483

SEQ ID NO: 70483 - RNA, 1701 nt, Artificial Sequence; identical to SEQ ID NO: 67863
  derived and/or modified sequence opt1 from hemagglutinin__InfluenzaA__AFN19485

SEQ ID NO: 70484 - RNA, 1701 nt, Artificial Sequence; identical to SEQ ID NO: 70082
  derived and/or modified sequence opt1 from hemagglutinin__InfluenzaA__AFN19487

SEQ ID NO: 70485 - RNA, 1701 nt, Artificial Sequence
  derived and/or modified sequence opt1 from hemagglutinin__InfluenzaA__AFN19491
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggugcugcucggcuucaucaugugggccugccagaaggggaacauccggugcaacaucugcaucuga

SEQ ID NO: 70486 - RNA, 1701 nt, Artificial Sequence
  derived and/or modified sequence opt1 from hemagglutinin__InfluenzaA__AFN19493
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgccugcaucacgcccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 70487 - RNA, 1701 nt, Artificial Sequence
  derived and/or modified sequence opt1 from hemagglutinin__InfluenzaA__AFN19495
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcgccggggagaucugcgacagcccccaccacauccuggacggcgagaacugcacccucaucgacgcccugcugggggacccccagugcgacggcuuccagaacaagaagugggaccucuucguggagcgcucccgggcguacuccaacugcuaccccuacgacgugccggacuacgccagccugcgcucccuggucgccagcuccggcacccucgaguucaacaacgagagcuucaacuggacgggggugacccagaacggcaccuccagcgccugcauccggcgcuccaacaacagcuucuucucccggcugaacuggcugacccaccucaacuucaaguaccccgcgcugaacgugacgaugcccaacaacgagcaguucgacaagcuguacaucuggggcguccaccaccccgggaccgacaaggaccagaucuuccucuacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcugaucaacuccaccgggaaccucaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcuggccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccucaagagcacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcgcuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgccugcaucgggagcauccggaacggcaccuacgaccacgacguguaccgcgacgaggcccugaacaaccgguuccagaucaagggggucgagcucaaguccggcuacaaggacuggauccuguggaucagcuucgccaccuccugcuuccugcucugcguggcgcugcugggcuucaucaugugggccugccagaaggggaacauccgcugcaacaucugcaucuga

SEQ ID NO: 70488 - RNA, 1701 nt, Artificial Sequence
  derived and/or modified sequence opt1 from hemagglutinin__InfluenzaA__AFN19497
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcaacagcccccaccagauccucgacggggagaacugcacccugaucgacgcccugcucggcgacccccagugcgacggguuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcaggccgugaucccgaacaucgggagccggccccgcguccggaacauccccucccgcgugagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcacgugcaucacccccaacggcuccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacagcgagggccgggggcaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggguacaaggacuggauccuguggaucuccuucgccaucagcugcuuccuccugugcgucgcccugcucggcuucaucaugugggcgugccagaagggcaacauccggugcaacaucugcaucuga

SEQ ID NO: 70489 - RNA, 1701 nt, Artificial Sequence; identical to SEQ ID NO: 70439
  derived and/or modified sequence opt1 from hemagglutinin__InfluenzaA__AFN19499

SEQ ID NO: 70490 - RNA, 1701 nt, Artificial Sequence; identical to SEQ ID NO: 70438
  derived and/or modified sequence opt1 from hemagglutinin__InfluenzaA__AFN19501

SEQ ID NO: 70491 - RNA, 1701 nt, Artificial Sequence; identical to SEQ ID NO: 67990
  derived and/or modified sequence opt1 from hemagglutinin__InfluenzaA__AFN19503

SEQ ID NO: 70492 - RNA, 1701 nt, Artificial Sequence; identical to SEQ ID NO: 70439
  derived and/or modified sequence opt1 from hemagglutinin__InfluenzaA__AFN19507

SEQ ID NO: 70493 - RNA, 1701 nt, Artificial Sequence; identical to SEQ ID NO: 70438
  derived and/or modified sequence opt1 from hemagglutinin__InfluenzaA__AFN19509

SEQ ID NO: 70494 - RNA, 1701 nt, Artificial Sequence; identical to SEQ ID NO: 70439
  derived and/or modified sequence opt1 from hemagglutinin__InfluenzaA__AFN19513

SEQ ID NO: 70495 - RNA, 1701 nt, Artificial Sequence; identical to SEQ ID NO: 70438
  derived and/or modified sequence opt1 from hemagglutinin__InfluenzaA__AFN19515

SEQ ID NO: 70496 - RNA, 1701 nt, Artificial Sequence; identical to SEQ ID NO: 70439
  derived and/or modified sequence opt1 from hemagglutinin__InfluenzaA__AFN19517

SEQ ID NO: 70497 - RNA, 1701 nt, Artificial Sequence; identical to SEQ ID NO: 70439
  derived and/or modified sequence opt1 from hemagglutinin__InfluenzaA__AFN19519

SEQ ID NO: 70498 - RNA, 1701 nt, Artificial Sequence; identical to SEQ ID NO: 70082
  derived and/or modified sequence opt1 from hemagglutinin__InfluenzaA__AFN19521

SEQ ID NO: 70499 - RNA, 1701 nt, Artificial Sequence; identical to SEQ ID NO: 70438
  derived and/or modified sequence opt1 from hemagglutinin__InfluenzaA__AFN19523

SEQ ID NO: 70500 - RNA, 1701 nt, Artificial Sequence
  derived and/or modified sequence opt1 from hemagglutinin__InfluenzaA__AFN19527
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacuccagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugagcacgaagcgcagccagcaggccgugaucccgaacaucggcucccggccccgcauccggaacauccccagccgcaucuccaucuacuggaccaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70501 - RNA, 1701 nt, Artificial Sequence
  derived and/or modified sequence opt1 from hemagglutinin__InfluenzaA__AFN19529
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70502 - RNA, 1701 nt, Artificial Sequence; identical to SEQ ID NO: 70082
  derived and/or modified sequence opt1 from hemagglutinin__InfluenzaA__AFN19531

SEQ ID NO: 70503 - RNA, 1701 nt, Artificial Sequence; identical to SEQ ID NO: 70501
  derived and/or modified sequence opt1 from hemagglutinin__InfluenzaA__AFN19533

SEQ ID NO: 70504 - RNA, 1701 nt, Artificial Sequence
  derived and/or modified sequence opt1 from hemagglutinin__InfluenzaA__AFN19535
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacagcuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacaaccacgacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 70505 - RNA, 1701 nt, Artificial Sequence; identical to SEQ ID NO: 70082
  derived and/or modified sequence opt1 from hemagglutinin__InfluenzaA__AFN19537

SEQ ID NO: 70506 - RNA, 1701 nt, Artificial Sequence; identical to SEQ ID NO: 70082
  derived and/or modified sequence opt1 from hemagglutinin__InfluenzaA__AFN19539

SEQ ID NO: 70507 - RNA, 1701 nt, Artificial Sequence; identical to SEQ ID NO: 70082
  derived and/or modified sequence opt1 from hemagglutinin__InfluenzaA__AFN19543

SEQ ID NO: 70508 - RNA, 1701 nt, Artificial Sequence
  derived and/or modified sequence opt1 from hemagglutinin__InfluenzaA__AFN19545
augaagaccaucaucgcccugagcuacauccucugccugguguucgcccagaagcugcccggcuccgacaacagcaccgcgacgcucugccuggggcaccacgccgucccgaacggcaccaucgugaagaccaucaccaacgaccgcaucgaggugacgaacgccaccgagcugguccagaacuccagcaucggggagaucugcgacagcccccaccagauccucgacggcgagaacugcacccugaucgacgcccugcucggggacccccagugcgacggcuucaagaacaagaagugggaccuguucguggagcggagcaaggccuacuccaacugcuaccccuacgacgugccggacuacgcgagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccaguccgggaaguccuccaucaugcggagcgacgcccccaucggcaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70509 - RNA, 1701 nt, Artificial Sequence; identical to SEQ ID NO: 70082
  derived and/or modified sequence opt1 from hemagglutinin__InfluenzaA__AFN19547

SEQ ID NO: 70510 - RNA, 1701 nt, Artificial Sequence
  derived and/or modified sequence opt1 from hemagglutinin__InfluenzaA__AFN19549
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaagggggagaucugcaacagcccccaccagauccucgacggcgggaacugcacccugaucgacgcccugcucggcgacccccagugcgacggcuuccagaacaagaagugggaccuguucguggagcgcuccaaggcccacuccaacugcuaccccuacgacgugccggacuacgcgagccugcggucccucgucgccagcuccgggacccuggaguucaacaacgagagcuucaacuggacgggcgugacccagaacgggaccuccagcgccugcaugcgccgguccaacaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccagcggccggaucaccguguccaccaagcgcagccagcaggccgugaucccgaacaucggcagccggccccgcguccggaacauccccucccgcgugagcaucuacuggacgaucgugaagcccggggacauccugcucaucaacuccaccggcaaccugaucgccccgcggggguacuucaagauccgcagcggcaaguccagcaucaugcgguccgacgcccccaucggcaagugcaacagcgcgugcaucacccccaacggguccauccccaacgacaagccguuccagaacgucaaccgcaucaccuacggcgccugcccccgguacgugaagcagaacacgcugaagcucgccaccgggaugcgcaacgugcccgagaagcagacccggggcaucuucggggccaucgccggcuucaucgagaacggcugggaggggauggucgacggcugguacggguuccgccaccagaacagcgagggccgggggcaggcggccgaccugaaguccacccaggccgccaucgaccagaucaacggcaagcugaaccgccucaucggcaagacgaacgagaaguuccaccagaucgagaaggaguucagcgagguggaggggcggauccaggacaucgagaaguacguggaggacaccaagaucgaccugugguccuacaacgccgagcugcucgucgcgcuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcucaagagcggcuacaaggacuggauccuguggaucuccuucgccaucagcugcuuccugcucugcgucgcgcugcugggguucaucaugugggccugccagaagggcaacauccggugcaacaucugcaucuga

SEQ ID NO: 70511 - RNA, 1701 nt, Artificial Sequence
  derived and/or modified sequence opt1 from hemagglutinin__InfluenzaA__AFN19551
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccacugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacagcuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacaaccacgacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 70512 - RNA, 1701 nt, Artificial Sequence; identical to SEQ ID NO: 70461
  derived and/or modified sequence opt1 from hemagglutinin__InfluenzaA__AFN19553

SEQ ID NO: 70513 - RNA, 1701 nt, Artificial Sequence; identical to SEQ ID NO: 70461
  derived and/or modified sequence opt1 from hemagglutinin__InfluenzaA__AFN19555

SEQ ID NO: 70514 - RNA, 1701 nt, Artificial Sequence; identical to SEQ ID NO: 70082
  derived and/or modified sequence opt1 from hemagglutinin__InfluenzaA__AFN19557

SEQ ID NO: 70515 - RNA, 1701 nt, Artificial Sequence; identical to SEQ ID NO: 70461
  derived and/or modified sequence opt1 from hemagglutinin__InfluenzaA__AFN19559

SEQ ID NO: 70516 - RNA, 1701 nt, Artificial Sequence; identical to SEQ ID NO: 70469
  derived and/or modified sequence opt1 from hemagglutinin__InfluenzaA__AFN19561

SEQ ID NO: 70517 - RNA, 1701 nt, Artificial Sequence
  derived and/or modified sequence opt1 from hemagglutinin__InfluenzaA__AFN19563
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaccuccugcuuccuccugugcguggcccugcucggcuucaucaugugggccugccagaaggggaacauccgcugcaacaucugcaucuga

SEQ ID NO: 70518 - RNA, 1701 nt, Artificial Sequence; identical to SEQ ID NO: 70439
  derived and/or modified sequence opt1 from hemagglutinin__InfluenzaA__AFN19565

SEQ ID NO: 70519 - RNA, 1701 nt, Artificial Sequence
  derived and/or modified sequence opt1 from hemagglutinin__InfluenzaA__AFN19567
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacaacuccuucuucagccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 70520 - RNA, 1701 nt, Artificial Sequence; identical to SEQ ID NO: 70082
  derived and/or modified sequence opt1 from hemagglutinin__InfluenzaA__AFN19569

SEQ ID NO: 70521 - RNA, 1701 nt, Artificial Sequence
  derived and/or modified sequence opt1 from hemagglutinin__InfluenzaA__AFN19571
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacucccagagcagcgggcggaucaccguguccacgaagcgcagccagcaggcggugaucccgaacaucggcucccggccccgcauccggaacauccccagccgcaucuccaucuacuggaccaucgucaagcccggcgacauccugcucaucaacagcaccgggaaccugaucgccccgcggggcuacuuccgcauccgguccgggaaguccuccaucaugcgcagcgacgcccccaucggcaagugcaacuccgagugcaucacccccaacggcagcauccccaacgacaagccguuccagaacgugaaccggaucacguacgggcccugcccccgcuacgugaagcaguccacccugaagcucgccaccggcaugcggaacguccccgagaagcagacccgcgggaucuucggcgccaucgcgggguucaucgagaacggcugggagggcaugguggacgggugguacggcuaccggcaccagaacagcgaggggcgcggccaggccgccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccuguggaccuacaacgcggagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggagcauccggaacggcaccuacaaccacgacguguaccgcgacgaggcccucaacaaccgguuccagaucaagggggucgagcugaaguccggcuacaaggacuggauccuguggaucagcuucgcgaucagcugcuuccuccugugcguggcccugcucggcuucaucaugugggccugccagaaggggaacauccgcugcaacaucugcaucuga

SEQ ID NO: 70522 - RNA, 1701 nt, Artificial Sequence
  derived and/or modified sequence opt1 from hemagglutinin__InfluenzaA__AFN19573
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggaagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguacagcgcccugaacgugaccaugcccaacaaggagcaguucgacaagcucuacaucuggggcguccaccaccccgggaccgacaaggaccagaucucccuguacgcgcaggccagcgggcggaucaccgugagcacgaagcgcucccagcagaccgugauccccaacaucggcagccggccgcgcguccggaacauccccucccgcaucagcaucuacuggaccaucgugaagcccggcgacauccugcucaucaacuccaccgggaaccugaucgcgccccggggcuacuucaagaugcagagcgggaaguccagcaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 70523 - RNA, 1701 nt, Artificial Sequence
  derived and/or modified sequence opt1 from hemagglutinin__InfluenzaA__AFN19575
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacaacccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagagcacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70524 - RNA, 1701 nt, Artificial Sequence; identical to SEQ ID NO: 70438
  derived and/or modified sequence opt1 from hemagglutinin__InfluenzaA__AFN19577

SEQ ID NO: 70525 - RNA, 1701 nt, Artificial Sequence; identical to SEQ ID NO: 70438
  derived and/or modified sequence opt1 from hemagglutinin__InfluenzaA__AFN19579

SEQ ID NO: 70526 - RNA, 1701 nt, Artificial Sequence; identical to SEQ ID NO: 70438
  derived and/or modified sequence opt1 from hemagglutinin__InfluenzaA__AFN19581

SEQ ID NO: 70527 - RNA, 1701 nt, Artificial Sequence; identical to SEQ ID NO: 70438
  derived and/or modified sequence opt1 from hemagglutinin__InfluenzaA__AFN19583

SEQ ID NO: 70528 - RNA, 1701 nt, Artificial Sequence
  derived and/or modified sequence opt1 from hemagglutinin__InfluenzaA__AFN19587
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggugaacugcacccugaucgacgcccugcucggcgacccccagugcgacggguuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugagcacgaagcgcucccagcaggccgucaucccgaacaucgggagccggccccgcauccggaacauccccucccgcaucagcaucuacuggaccaucgugaagcccggcgacauccugcucaucaacuccaccggcaaccugaucgccccgcggggguacuucaagauccgcagcggcaaguccagcaucaugcgguccgacgcccccaucgggaagugcaacagcgagugcaucacccccaacggcuccauccccaacgacaagccguuccagaacgugaaccgcaucacguacggcgccugcccccgguacgucaagcagagcacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacgagugcgacaacgcgugcaucggcagcauccgcaacgggaccuacaaccacgacgucuaccgggacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 70529 - RNA, 1701 nt, Artificial Sequence; identical to SEQ ID NO: 70438
  derived and/or modified sequence opt1 from hemagglutinin__InfluenzaA__AFN19589

SEQ ID NO: 70530 - RNA, 1701 nt, Artificial Sequence
  derived and/or modified sequence opt1 from hemagglutinin__InfluenzaA__AFN19591
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcaugcgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaacgggaacauccggugcaacaucugcaucuga

SEQ ID NO: 70531 - RNA, 1701 nt, Artificial Sequence; identical to SEQ ID NO: 70438
  derived and/or modified sequence opt1 from hemagglutinin__InfluenzaA__AFN19593

SEQ ID NO: 70532 - RNA, 1701 nt, Artificial Sequence; identical to SEQ ID NO: 70439
  derived and/or modified sequence opt1 from hemagglutinin__InfluenzaA__AFN19595

SEQ ID NO: 70533 - RNA, 1701 nt, Artificial Sequence; identical to SEQ ID NO: 70439
  derived and/or modified sequence opt1 from hemagglutinin__InfluenzaA__AFN19599

SEQ ID NO: 70534 - RNA, 1701 nt, Artificial Sequence; identical to SEQ ID NO: 70501
  derived and/or modified sequence opt1 from hemagglutinin__InfluenzaA__AFN19601

SEQ ID NO: 70535 - RNA, 1701 nt, Artificial Sequence; identical to SEQ ID NO: 70082
  derived and/or modified sequence opt1 from hemagglutinin__InfluenzaA__AFN19607

SEQ ID NO: 70536 - RNA, 1701 nt, Artificial Sequence; identical to SEQ ID NO: 70438
  derived and/or modified sequence opt1 from hemagglutinin__InfluenzaA__AFN19609

SEQ ID NO: 70537 - RNA, 1701 nt, Artificial Sequence
  derived and/or modified sequence opt1 from hemagglutinin__InfluenzaA__AFN19611
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgccggagcaacaacuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcagccagcaggccgugaucccgaacaucggcagccggccccgcauccggaacauccccucccgcaucagcaucuacuggacgaucgucgagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70538 - RNA, 1701 nt, Artificial Sequence; identical to SEQ ID NO: 70461
  derived and/or modified sequence opt1 from hemagglutinin__InfluenzaA__AFN19613

SEQ ID NO: 70539 - RNA, 1701 nt, Artificial Sequence; identical to SEQ ID NO: 70439
  derived and/or modified sequence opt1 from hemagglutinin__InfluenzaA__AFN19617

SEQ ID NO: 70540 - RNA, 1701 nt, Artificial Sequence
  derived and/or modified sequence opt1 from hemagglutinin__InfluenzaA__AFN19619
augaagaccaucaucgcccugagccacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagcaagccccggauccgcaacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggugcugcucggcuucaucaugugggccugccagaaggggaacauccgcugcaacaucugcaucuga

SEQ ID NO: 70541 - RNA, 1701 nt, Artificial Sequence; identical to SEQ ID NO: 70501
  derived and/or modified sequence opt1 from hemagglutinin__InfluenzaA__AFN19623

SEQ ID NO: 70542 - RNA, 1701 nt, Artificial Sequence; identical to SEQ ID NO: 70438
  derived and/or modified sequence opt1 from hemagglutinin__InfluenzaA__AFN19629

SEQ ID NO: 70543 - RNA, 1701 nt, Artificial Sequence
  derived and/or modified sequence opt1 from hemagglutinin__InfluenzaA__AFN19631
augaagaccaucaucgcccugagcuacauccucugccugguguucgcccagaagcugcccgagaacgacuacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacgggaucaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccacgagcuccuucuucagccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcagccguccggccggaucacggugagcaccaagcgcagccagcaggccgugauccccaacaucgggucccggccccgcauccggaacauccccagccgcaucuccaucuacuggaccaucgucaagccgggcgacauccugcucaucaacagcaccggcaaccugaucgcgccccggggguacuucaagauccgcuccggcaagagcuccaucaugcggagcgacgcccccaucgggaagugcaacuccgagugcaucacgcccaacggcagcaucccgaacgacaagcccuuccagaacgugaaccgcaucaccuacggcgccugcccccgguacgugaagcaguccacccugaagcucgccaccgggaugcgcaacguccccgagaagcagacgcggggcaucuucggggccaucgccggcuucaucgagaacgggugggagggcaugguggacggcugguacggguuccgccaccagaacagcgagggccgggggcaggccgccgaccugaaguccacccaggcggccaucgaccagaucaacggcaagcugaaccgccucaucgggaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 70544 - RNA, 1701 nt, Artificial Sequence
  derived and/or modified sequence opt1 from hemagglutinin__InfluenzaA__AFN19633
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccaucagcacgaagcgcucccagcaggccgugaucccgaacaucggcagccggccccgcauccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgucaaccgcaucacguacggggccugcccccgguacgugaagcagagcacccugaagcucgcgaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 70545 - RNA, 1701 nt, Artificial Sequence
  derived and/or modified sequence opt1 from hemagglutinin__InfluenzaA__AFN19635
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacgggaucaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagccguccggccggaucaccgugagcacgaagcgcagccagcaggccgugauccccaacaucgggucccggccccgcauccggaacauccccagccgcaucuccaucuacuggaccaucgucaagccgggcgacauccugcucaucaacagcaccggcaaccugaucgcgccccggggguacuucaagauccgcuccggcaagagcuccaucaugcggagcgacgcccccaucgggaagugcaacuccgagugcaucacccccaacggcagcaucccgaacgacaagcccuuccagaacgugaaccgcaucacguacggcgccugcccccgguacgugaagcaguccacccugaagcucgccaccgggaugcgcaacguccccgagaagcagacccggggcaucuucggggccaucgccggcuucaucgagaacgggugggagggcaugguggacggcugguacggguuccgccaccagaacagcgagggccgggggcaggccgccgaccugaaguccacgcaggcggccaucgaccagaucaacggcaagcugaaccgccucaucgggaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggccugccagaagggcaacauccggugcaacaucugcaucuga

SEQ ID NO: 70546 - RNA, 1701 nt, Artificial Sequence; identical to SEQ ID NO: 70545
  derived and/or modified sequence opt1 from hemagglutinin__InfluenzaA__AFN19637

SEQ ID NO: 70547 - RNA, 1701 nt, Artificial Sequence; identical to SEQ ID NO: 70082
  derived and/or modified sequence opt1 from hemagglutinin__InfluenzaA__AFN19639

SEQ ID NO: 70548 - RNA, 1701 nt, Artificial Sequence; identical to SEQ ID NO: 70501
  derived and/or modified sequence opt1 from hemagglutinin__InfluenzaA__AFN19641

SEQ ID NO: 70549 - RNA, 1701 nt, Artificial Sequence; identical to SEQ ID NO: 70545
  derived and/or modified sequence opt1 from hemagglutinin__InfluenzaA__AFN19643

SEQ ID NO: 70550 - RNA, 1701 nt, Artificial Sequence; identical to SEQ ID NO: 70082
  derived and/or modified sequence opt1 from hemagglutinin__InfluenzaA__AFN19645

SEQ ID NO: 70551 - RNA, 1701 nt, Artificial Sequence
  derived and/or modified sequence opt1 from hemagglutinin__InfluenzaA__AFN19647
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccagauccucgacggggugaacugcacccugaucgacgcccugcucggcgacccccagugcgacggguuccagaacaagaagugggaccuguucguggagcgcagcaaggccuacuccaacugcuaccccuacgacgucccggacuacgcgagccugaagucccucguggccagcuccggcacgcuggaguucaacaacgagagcuucaacuggaccggcgugacccagaacgggaccuccagcgccugcauccggcgcuccaacagcuccuucuucagccggcugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccgcaucaccgugagcacgaagcggucccagcaggccgucaucccgaacaucgggagccgcccccggauccgcaacauccccucccggaucagcaucuacuggaccaucgugaagcccggcgacauccugcucaucaacuccaccggcaaccugaucgccccgcgcggguacuucaagauccagagcggcaaguccagcaucaugcgguccgacgcccccaucgggaagugcaacagcgagugcaucacccccaacggcuccauccccaacgacaagccguuccagaacgugaaccgcaucacguacggcgccugcccccgguacgucaagcagagcacccugaagcucgcgaccgggaugcgcaacgugcccgagaagcagacccggggcaucuucggggccaucgccggcuucaucgagaacgggugggagggcaugguggacggcugguacggguuccgccaccagaacuccgagggccgggggcaggccgccgaccugaaguccacgcaggcggccaucgaccagaucaacggcaagcugaaccgccucaucgggaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgcgugcaucggcagcauccggaacgggaccuacaaccacgacgucuaccgcgacgaggcccucaacaaccgcuuccagaucaagggcguggagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 70552 - RNA, 1701 nt, Artificial Sequence
  derived and/or modified sequence opt1 from hemagglutinin__InfluenzaA__AFN19649
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucagcgagaucugcgacagcccccaccagauccucgacggggagaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggcgugacccagaacgggaccuccagcgccugcauccgccgguccaacagcuccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcggccggaucaccgugagcaccaagcgcucccagcaggccgugaucccgaacaucgggagccggccccgcauccggaacauccccucccgcaucagcaucuacuggacgaucgucaagcccggcgacauccugcucaucaacuccaccggcaaccugaucgccccgcggggguacuucaagauccgcagcggcaaguccagcaucaugcgguccgacgcccccaucgggaagugcaacagcgagugcaucacccccaacggcuccauccccaacgacaagccguuccagaacgugaaccgcaucaccuacggcgccugcccccgguacgugaagcagagcacgcugaagcucgcgaccgggaugcgcaacguccccgagaagcagacccggggcaucuucggggccaucgccggcuucaucgagaacgggugggagggcaugauggacggcugguacggguuccgccaccagaacuccgagggccgggggcaggccgccgaccugaaguccacccaggcggccaucgaccagaucaacggcaagcugaaccgccucaucgggaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaagggcaacauccggugcaacaucugcaucuga

SEQ ID NO: 70553 - RNA, 1701 nt, Artificial Sequence; identical to SEQ ID NO: 70545
  derived and/or modified sequence opt1 from hemagglutinin__InfluenzaA__AFN19653

SEQ ID NO: 70554 - RNA, 1701 nt, Artificial Sequence; identical to SEQ ID NO: 70461
  derived and/or modified sequence opt1 from hemagglutinin__InfluenzaA__AFN19663

SEQ ID NO: 70555 - RNA, 1701 nt, Artificial Sequence; identical to SEQ ID NO: 70469
  derived and/or modified sequence opt1 from hemagglutinin__InfluenzaA__AFN19665

SEQ ID NO: 70556 - RNA, 1701 nt, Artificial Sequence
  derived and/or modified sequence opt1 from hemagglutinin__InfluenzaA__AFN19667
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcaugcgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70557 - RNA, 1701 nt, Artificial Sequence
  derived and/or modified sequence opt1 from hemagglutinin__InfluenzaA__AFN19669
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccgaacuacgcgucccugcggagccuggucgccuccagcggcacccucgaguucaacaacgaguccuucaacuggacgggggugacccagaacggcaccagcuccgccugcaugcgccggagcaacuccagcuucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcuggcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagacgaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 70558 - RNA, 1701 nt, Artificial Sequence
  derived and/or modified sequence opt1 from hemagglutinin__InfluenzaA__AFN19671
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgagagcauccggaacgggaccuacgaccacgacguguaccgcgacgaggcccucaacaaccgguuccagaucaagggcgucgagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 70559 - RNA, 1701 nt, Artificial Sequence; identical to SEQ ID NO: 70082
  derived and/or modified sequence opt1 from hemagglutinin__InfluenzaA__AFN19674

SEQ ID NO: 70560 - RNA, 1701 nt, Artificial Sequence; identical to SEQ ID NO: 70082
  derived and/or modified sequence opt1 from hemagglutinin__InfluenzaA__AFN19676

SEQ ID NO: 70561 - RNA, 1701 nt, Artificial Sequence; identical to SEQ ID NO: 70469
  derived and/or modified sequence opt1 from hemagglutinin__InfluenzaA__AFN19678

SEQ ID NO: 70562 - RNA, 1701 nt, Artificial Sequence
  derived and/or modified sequence opt1 from hemagglutinin__InfluenzaA__AFN19682
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccgaacuacgcgucccugcggagccucgucgccuccagcggcacccuggaguucaacaacgaguccuucaacuggacgggggugacccagaacggcaccagcuccgccugcaugcgccggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacaucaagugcaacaucugcaucuga

SEQ ID NO: 70563 - RNA, 1701 nt, Artificial Sequence
  derived and/or modified sequence opt1 from hemagglutinin__InfluenzaA__AFN19684
augaagaccaucaucgcccugagcuacauccucugccuggccuucgcgcagaagcugcccggcaacgacaacuccaccgccacgcucugccuggggcaccacgccgugccgaacggcaccaucgucaagaccaucaccaacgaccagaucgaggugacgaacgccaccgagcuggugcagagcuccagcaccggggagaucugcgacagcccccaccagauccucgacggcgagaacugcacccugaucgacgcccugcucggggacccccagugcgacggcuuccagaacaagaagugggaccuguucgucgagcgcagcaaggcguacuccaacugcuaccccuacgacgugccggacuacgccagccugcggucccucguggccagcuccggcacgcuggaguucaacaacgagagcuucaacuggaccggggucacccagaacggcaccuccagcgccugcauccgcggguccaacagcuccuucuucagccggcugaacuggcucacgcaccugaacuucaaguaccccgcgcugaacgugaccaugcccaacaacgagcaguucgacaagcucuacaucuggggcgugcaccaccccgggaccgacaaggaccagaucuuccuguacgcccaguccagcggccgcaucaccgucagcacgaagcggucccagcaggccgugaucccgaacaucggcagccgcccccggauccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacccccaacggguccauccccaacgacaagccguuccagaacgucaaccggaucacguacggcgcgugcccccgcuacgugaagcagagcacccugaagcucgccaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgcggaccugaaguccacgcaggccgccaucgaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacaaccacaacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggcgugccagaagggcaacauccgcugcaacaucugcaucuga

SEQ ID NO: 70564 - RNA, 1701 nt, Artificial Sequence
  derived and/or modified sequence opt1 from hemagglutinin__InfluenzaA__AFN19686
augaagaccaucaucgcccugagcuacauccucugccuggccuucgcgcagaagcugcccggcaacgacaacuccaccgccacgcucugccuggggcaccacgccgugccgaacggcaccaucgucaagaccaucaccaacgaccagaucgaggugacgaacgccaccgagcuggugcagagcuccagcaccggggagaucugcgacagcccccaccagauccucgacggcgagaacugcacccugaucgacgcccugcucggggacccccagugcgacggcuuccagaacaagaagugggaccuguucgucgagcgcagcaaggcguacuccaacugcuaccccuacgacgugccggacuacgccagccugcggucccucguggccagcuccggcacgcuggaguucaacaacgagagcuucaacuggaccggggucacccagaacggcaccuccagcgccugcauccgccgguccaacagcuccuucuucagccgccugaacuggcucacgcaccugaacuucaaguaccccgcgcugaacgugaccaugcccaacaacgagcaguucgacaagcucuacaucuggggcgugcaccaccccgggaccgacaaggaccagaucuuccuguacgcccaguccagcgggcggaucaccgucagcacgaagcgcucccagcaggccgugaucccgaacaucggcagccggccccgcauccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgucaaccgcaucacguacggggcgugcccccgguacgugaagcagagcacccugaagcucgccaccggcaugcgcaacauccccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacaaccacaacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 70565 - RNA, 1701 nt, Artificial Sequence
  derived and/or modified sequence opt1 from hemagglutinin__InfluenzaA__AFN19688
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 70566 - RNA, 1701 nt, Artificial Sequence
  derived and/or modified sequence opt1 from hemagglutinin__InfluenzaA__AFN19690
augaagaccaccaucgcccugagcuacauccucugccugguguucgcccagaagcugcccggcaacgacaacuccacggcgacccucugccuggggcaccacgccgucccgaacggcaccaucgugaagaccaucacgaacgaccgcaucgaggugaccaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacgcuggaguucaacaacgaguccuucaacuggaccggggugacccagaacggcaccagcuccgccugcauccggcgcagcaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcgcaucaccguguccacgaagcggagccagcaggccgugaucccgaacaucggcagccgcccccggauccgcaacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucacguacggggccugcccccgcuacgugaagcagagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgaccugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 70567 - RNA, 1701 nt, Artificial Sequence
  derived and/or modified sequence opt1 from hemagglutinin__InfluenzaA__AFN19692
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccgacagcuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcagccagcaggccgugaucccgaacaucggcucccggccccgcauccggaacauccccagccgcaucuccaucuacuggaccaucgucaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacaaccacgacguguaccgggacgaggcccugaacaaccgcuuccagaucaagggggucgagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 70568 - RNA, 1701 nt, Artificial Sequence
  derived and/or modified sequence opt1 from hemagglutinin__InfluenzaA__AFN19694
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagccccaucggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuacccguacgacgugcccgacuacgcgagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcccugaacgugacgaugcccaacaacgagcaguucgacaagcucuacaucuggggcguccaccacccggggaccgacaaggaccagaucuuccuguacgcgcagagcuccgggcgcaucaccgugagcaccaagcggucccagcaggccgugauccccaacaucggcagccgcccccggauccgcaacauccccagccggaucuccaucuacuggacgaucgucaagccgggcgacauccugcucaucaacagcaccgggaaccugaucgcgccccgcggcuacuucaagauccgguccgggaaguccuccaucaugcgcagcgacgcccccaucggcaagugcaaguccgagugcaucacccccaacggcagcaucccgaacgacaagcccuuccagaacgugaaccggaucaccuacggggccugcccccgcuacgugaagcaguccacgcugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70569 - RNA, 1701 nt, Artificial Sequence
  derived and/or modified sequence opt1 from hemagglutinin__InfluenzaA__AFN19700
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgagcgcuucaacugguccggggugacgcagaacggcaccagcuccgccugcaugcggcgcagcaacuccagcuucuucucccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaacuccgagugcaucacccccaacggcagcauccccaacgacaagccguuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70570 - RNA, 1701 nt, Artificial Sequence
  derived and/or modified sequence opt1 from hemagglutinin__InfluenzaA__AFN19702
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcggggcaaggccuacuccaacugcuaccccuacgacgugccggacuacgcgagccugcgcucccucgucgccagcuccgggacccuggaguucaacaacgagagcuucaacuggacgggcgugacccagaacgggaccuccagcgccugcauccggcgcuccaacaacagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggucccagcaggccgugaucccgaacaucggcagccgcccccggauccgcaacauccccagccggaucuccaucuacuggacgaucgucaagcccggggacauccugcucaucaacagcaccggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 70571 - RNA, 1701 nt, Artificial Sequence; identical to SEQ ID NO: 67823
  derived and/or modified sequence opt1 from hemagglutinin__InfluenzaA__AFN19709

SEQ ID NO: 70572 - RNA, 1701 nt, Artificial Sequence
  derived and/or modified sequence opt1 from hemagglutinin__InfluenzaA__AFN19719
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcacccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcgucuaccagauccuggccaucuacuccaccguggcgagcucccuggugcucgucgugagccugggggccaucagcuucuggaugugcuccaacggcagccugcagugccggaucugcaucuga

SEQ ID NO: 70573 - RNA, 1701 nt, Artificial Sequence; identical to SEQ ID NO: 67443
  derived and/or modified sequence opt1 from hemagglutinin__InfluenzaA__AFN19730

SEQ ID NO: 70574 - RNA, 1701 nt, Artificial Sequence; identical to SEQ ID NO: 67823
  derived and/or modified sequence opt1 from hemagglutinin__InfluenzaA__AFN19736

SEQ ID NO: 70575 - RNA, 1701 nt, Artificial Sequence
  derived and/or modified sequence opt1 from hemagglutinin__InfluenzaA__AFN19748
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaccgggaacagcuaccccaagcuguccaagagcuacaucaacgacaagggcaaggaggugcugguccucugggggauccaccaccccagcacgaccgccgaccagcagucccuguaccagaacgccgacaccuacguguucgugggcaccagccgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 70576 - RNA, 1701 nt, Artificial Sequence; identical to SEQ ID NO: 67832
  derived and/or modified sequence opt1 from hemagglutinin__InfluenzaA__AFN19757

SEQ ID NO: 70577 - RNA, 1701 nt, Artificial Sequence; identical to SEQ ID NO: 67823
  derived and/or modified sequence opt1 from hemagglutinin__InfluenzaA__AFN19768

SEQ ID NO: 70578 - RNA, 1701 nt, Artificial Sequence
  derived and/or modified sequence opt1 from hemagglutinin__InfluenzaA__AFN19781
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccguggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggcgagcucccuggugcucgucgugagccugggggccaucagcuucuggaugugcuccaacggcagccugcagugccggaucugcaucuga

SEQ ID NO: 70579 - RNA, 1701 nt, Artificial Sequence
  derived and/or modified sequence opt1 from hemagglutinin__InfluenzaA__AFN19791
augaaggccauccuggugguccuccuguacaccuucgccaucgcgaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccuccaaguacagcaagaaguucaagcccgagaucgccguccggccgaaggugcgcgaccaggagggccggaugaacuacuacuggacgcugguggagcccggggacaagaucaccuucgaggcgaccggcaaccuccuggucccccgcuacgccuucgccauggagcggaacgccggguccggcaucaucaucagcgacacccccgugcacgacugcaacacgaccugccagaccccggagggcgccaucaacaccucccugcccuuccagaacauccaccccaucacgaucgggaagugccccaaguacgucaagagcaccaagcuccgccuggcgaccggccugcggaacgugccguccauccagagccgcggccucuucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcggaucgagaaccugaacaagaaggucgacgacggcuuccuggacaucuggacguacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugaucgugucccugggggccaucagcuucuggaugugcuccaacggcagccuccagugccgcaucugcaucuga

SEQ ID NO: 70580 - RNA, 1701 nt, Artificial Sequence; identical to SEQ ID NO: 67823
  derived and/or modified sequence opt1 from hemagglutinin__InfluenzaA__AFN19806

SEQ ID NO: 70581 - RNA, 1701 nt, Artificial Sequence
  derived and/or modified sequence opt1 from hemagglutinin__InfluenzaA__AFN19808
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccaacagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccaacuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccuccaccagcgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgcccacgacugcaacacgaccugccagaccccgaagggcgcgaucaacaccucccugcccuuccagaacauccaccccaucaccaucgggaagugccccaaguacgugaacagcaccaagcugcggcucgccaccggccugcgcaacgugccguccauccagagccgggggcuguucggcgccaucgccggguucaucgagggcggcuggacggggauggucgacggcugguacggguaccaccaccagaacgagcagggcuccggguacgccgcggaccucaagagcacccagaacgccaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagagcacccgcaucuaccagauccuggccaucuacuccaccguggccagcucccugguccucguggugagccugggggccaucagcuucuggaugugcuccaacggcagccugcagugccggaucugcaucuga

SEQ ID NO: 70582 - RNA, 1701 nt, Artificial Sequence; identical to SEQ ID NO: 67832
  derived and/or modified sequence opt1 from hemagglutinin__InfluenzaA__AFN19814

SEQ ID NO: 70583 - RNA, 1701 nt, Artificial Sequence
  derived and/or modified sequence opt1 from hemagglutinin__InfluenzaA__AFN19816
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaucagcuucuggaugugcagcaacggcucccugcagugccggaucugcaucuga

SEQ ID NO: 70584 - RNA, 1701 nt, Artificial Sequence
  derived and/or modified sequence opt1 from hemagglutinin__InfluenzaA__AFN19821
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaagcugaagcccgagaucgccauccgcccgaagguccgggaccaggagggccgcaugaacuacuacuggacccucguggagcccgggggcaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccagccugcccuuccagaacauccaccccaucaccaucggcaagugccccaaguacgugaaguccacgaagcuccggcuggccaccgggcugcgcaacgucccgagcauccagucccggggccucuucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggugaacagcgucaucgagaagaugaacacccaguucaccgcggugggcaaggaguucaaccaccuggagaagcgcaucgagaaccucaacaagaaggucgacgacggguuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgggaggagaucgacggggugaagcuggagagcacccgcaucuaccagauccuggccaucuacuccaccgucgcgagcucccucgugcugguggucagccugggcgccaucagcuucuggaugugcuccaacggcagccuccagugccggaucugcaucuga

SEQ ID NO: 70585 - RNA, 1701 nt, Artificial Sequence; identical to SEQ ID NO: 67443
  derived and/or modified sequence opt1 from hemagglutinin__InfluenzaA__AFN19831

SEQ ID NO: 70586 - RNA, 1701 nt, Artificial Sequence
  derived and/or modified sequence opt1 from hemagglutinin__InfluenzaA__AFN19849
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucggggacggcugcuucgaguucuaccacaagugcgacaacacgugcauggagagcgugaagaacgggaccuacgacuaccccaaguacuccgaggaggcgaagcucaaccgcgaggagaucgacggcgugaagcuggagagcacccggaucuaccagauccuggccaucuacuccaccgucgccagcagccucgugcugguggucucccugggggccaucagcuucuggaugugcuccaacggcagccuccagugccgcaucugcaucuga

SEQ ID NO: 70587 - RNA, 1701 nt, Artificial Sequence
  derived and/or modified sequence opt1 from hemagglutinin__InfluenzaA__AFN19865
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccuggugcacgacugcaacacgaccugccagacccccaagggcgccaucaacaccagccugccguuccagaacauccaccccaucaccaucgggaagugccccaaguacgugaaguccaccaagcuccggcuggcgacgggccugcgcaacguccccagcauccagucccggggccucuucggggccaucgccggguucaucgagggcggcuggaccgggaugguggacggcugguacggguaccaccaccagaacgagcagggcagcggguacgccgccgaccugaaguccacccagaacgcgaucgacaagaucaccaacaaggugaacagcgucaucgagaagaugaacacgcaguucaccgccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggaggagaucgacggcgugaagcuggagagcacccgcaucuaccagauccuggcgaucuacuccaccgucgccagcucccucgugcugguggucagccugggggccaucagcuucuggaugugcuccaacggcagccuccagugccggaucugcaucuga

SEQ ID NO: 70588 - RNA, 1701 nt, Artificial Sequence
  derived and/or modified sequence opt1 from hemagglutinin__InfluenzaA__AFN19875
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgagaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggccaccggcaaccuccuggucccccgcuacgcguucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggccaucuacuccaccgucgcgagcagccucgugcugguggucucccugggggccaucagcuucuggaugugcuccaacggcagccuccagugccgcaucugcaucuga

SEQ ID NO: 70589 - RNA, 1701 nt, Artificial Sequence
  derived and/or modified sequence opt1 from hemagglutinin__InfluenzaA__AFN19895
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucuccaagagcuacaucaacgacaagggcaaggaggugcugguccugugggggauccaccaccccagcaccacggccgaccagcagucccucuaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccgggagcggcaucaucaucuccgacacccccgugcacgacugcaacaccacgugccagaccccgaagggcgccaucaacaccagccuccccuuccagaacauccaccccaucaccaucgggcggugccccaaguacgugaaguccacgaagcugcgccuggccaccggccuccggaacgucccgagcauccagucccgcgggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacagcgucaucgagaagaugaacacccaguucaccgcggugggcaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaccgggaacggcugcuucgaguucuaccacaagugcgacaacacgugcauggagagcgugaagaacgggaccuacgacuaccccaaguacuccgaggaggccaagcugaaccgcgaggugaucgacggcgucaagcuggagagcacccggaucuaccagauccucgccaucuacuccaccguggcgagcucccuggugcuggucgugagccucggggccaucagcuucuggaugugcuccaacggcagccugcagugccgcaucugcaucuga

SEQ ID NO: 70590 - RNA, 1701 nt, Artificial Sequence
  derived and/or modified sequence opt1 from hemagglutinin__InfluenzaA__AFN19905
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccguggacaagaucacgaacaaggucaacuccgugaucgagaagaugaacacccaguucaccgcggucggcaaggaguucaaccaccuggagaagcgcaucgagaaccugaacaagaagguggacgacggguuccucgacaucuggaccuacaacgccgagcugcuggugcuccuggagaacgagcggacgcuggacuaccacgacagcaacgucaagaaccucuacgagaaggugcgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggagaagaucgacggggucaagcucgaguccacccgcaucuaccagauccuggccaucuacagcaccguggcguccagccuggugcucaucgucucccugggcgccaucagcuucuggaugugcagcaacggcucccugcagugccggaucugcaucuga

SEQ ID NO: 70591 - RNA, 1701 nt, Artificial Sequence
  derived and/or modified sequence opt1 from hemagglutinin__InfluenzaA__AFN19915
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccagcagcuacaucaacgacaagggcaaggaggugcugguccucugggggauccaccaccccuccaccagcgccgaccagcagucccuguaccagaacgccgacgccuacguguucgugggcacgagcgaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgcccagggcagcggguacgccgcggaccugaaguccacccagaacgccaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggcgaagcucaaccgcgaggagaucgacggcgugaagcuggaguccacccggaucuaccagauccuggccaucuacagcaccgucgccagcucccucgugcugguggucagccugggggccaucuccuucuggaugugcagcaacggcucccuccagugccgcaucugcaucuga

SEQ ID NO: 70592 - RNA, 1701 nt, Artificial Sequence
  derived and/or modified sequence opt1 from hemagglutinin__InfluenzaA__AFN19922
augaaggccauccugguggucgugcucuacaccuucgccaccgcgaacgccgacacgcugugcaucggcuaccacgccaacaacagcaccgacaccguggacaccguccuggagaagaacgugacggugacccacuccgucaaccuccuggaggacaagcacaacgggaagcugugcaagcuccgcggcguggcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgucagcuccuucgagcgcuucgagaucuuccccaagaccagcuccuggcccaaccacgacagcaacaagggggugaccgccgccugcccgcacgccggcgcgaagggguucuacaagaaccugaucuggcuggugaagaagggcaacuccuaccccaagcucagccgguccuacaucaacgacaaggggaaggagguccuggugcuguggggcauccaccaccccagcaccacggccgaccagcagagccucuaccagaacgccgacaccuacguguucgucggcaccucccgcuacagcaagaaguucaagcccgagaucgccauccggccgaaggugcgcgaccaggaggggcggaugaacuacuacuggacccugguggagcccggcgacaagaucacguucgaggccaccgggaaccuggucgugccccgcuacgcguucgccauggagcggaacgccggcuccggcaucaucaucagcgacacccccgcccaggacugcaacaccacgugccagaccccgaagggggccaucaacaccucccuccccuuccagaacauccaccccaucaccaucggcaagugccccaaguacgucaagagcacgaagcugcgccuggcgaccgggcuccggaacgugccguccauccagagccgcggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucacgaacaaggugaacuccgucaucgagaagaugaacacccaguucaccgccgugggcaaggaguucaaccaccuggagaagcggaucgagaaccugaacaagaaggucgacgacggguuccuggacaucuggaccuacaacgccgagcuccuggugcugcucgagaacgagcgcacgcuggacuaccacgacagcaacgugaagaaccuguacgagaagguccggaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcuggaguccacccggaucuaccagauccucgcgaucuacagcaccgucgccuccagccuggugcugguggucucccucggcgccaucagcuucuggaugugcagcaacggcucccugcagugccgcaucugcaucuga

SEQ ID NO: 70593 - RNA, 1701 nt, Artificial Sequence; identical to SEQ ID NO: 67462
  derived and/or modified sequence opt1 from hemagglutinin__InfluenzaA__AFN19931

SEQ ID NO: 70594 - RNA, 1701 nt, Artificial Sequence
  derived and/or modified sequence opt1 from hemagglutinin__InfluenzaA__AFN19941
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaucagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcaggccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgcccagggcagcggguacgccgcggaccugaaguccacccagaacgccaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggcgaagcucaaccgcgaggagaucgacggcgugaagcuggaguccacccggaucuaccagauccuggccaucuacagcaccgucgccuccagccucgugcugguggucagccugggggccaucuccuucuggaugugcagcaacggcucccuccagugccgcaucugcaucuga

SEQ ID NO: 70595 - RNA, 1701 nt, Artificial Sequence
  derived and/or modified sequence opt1 from hemagglutinin__InfluenzaA__AFN19951
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgcggccagcucccugguccucguggugagccugggggccaucagcuucuggaugugcuccaacggcagccugcagugccggaucugcaucuga

SEQ ID NO: 70596 - RNA, 1701 nt, Artificial Sequence; identical to SEQ ID NO: 67823
  derived and/or modified sequence opt1 from hemagglutinin__InfluenzaA__AFN19966

SEQ ID NO: 70597 - RNA, 1701 nt, Artificial Sequence
  derived and/or modified sequence opt1 from hemagglutinin__InfluenzaA__AFN19972
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacaacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcgucuaccagauccuggccaucuacuccaccguggcgagcucccuggugcucgucgugagccugggggccaucagcuucuggaugugcuccaacggcagccugcagugccggaucugcaucuga

SEQ ID NO: 70598 - RNA, 1701 nt, Artificial Sequence
  derived and/or modified sequence opt1 from hemagglutinin__InfluenzaA__AFN19978
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggagaagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 70599 - RNA, 1701 nt, Artificial Sequence; identical to SEQ ID NO: 67823
  derived and/or modified sequence opt1 from hemagglutinin__InfluenzaA__AFN19983

SEQ ID NO: 70600 - RNA, 1701 nt, Artificial Sequence
  derived and/or modified sequence opt1 from hemagglutinin__InfluenzaA__AFN19993
augaaggccauccuggugguccuccuguacaccguggccaccacgaacgcggacacccugugcaucggcuaccacgccaacaacagcaccgacaccguggacacgguccucgagaagaacgugaccgugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgucagcuccuucgagcgcuucgagaucuuccccaagaccagcuccuggcccaaccacgacagcaacaagggcgugaccgccgccugcccgcacgccggcgccaagggguucuacaagaaccugaucuggcucgugaagaagggcaacuccuaccccaagcugagcaaguccuacaucaacgacaaggggaaggagguccuggugcucuggggcauccaccaccccagcacgaccgcggaccagcagagccuguaccagaacgccgacaccuacguguucgucggcaccucccgguacagcaagaaguucaagcccgagaucgccauccgcccgaaggugcgggaccaggaggggcgcaugaacuacuacuggacgcugguggagcccggcgacaagaucaccuucgaggccaccgggaaccucgucgugccccgguacgccuucgcgauggagcgcaacgccggcuccggcaucaucaucagcgacacccccgugcacgacugcaacacgaccugccagaccccgaagggggccaucaacaccucccugcccuuccagaacauccaccccaucacgaucggcaagugccccaaguacgucaagagcaccaagcugcggcucgccaccgggcugcgcaacgugccguccauccagagccggggccuguucggggccaucgcgggcuucaucgagggcggguggaccggcaugguggacgggugguacggcuaccaccaccagaacgagcagggguccggcuacgccgccgaccucaagagcacgcagaacgccaucgacaagaucaccaacaaggucaacuccgugaucgagaagaugaacacccaguucaccgccgucggcaaggaguucaaccaccuggagaagcgcaucgagaaccugaacaagaagguggacgacggguuccucgacaucuggacguacaacgcggagcugcuggugcuccuggagaacgagcggacccuggacuaccacgacagcaacgucaagaaccucuacgagaaggugcgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggucaagcucgaguccacccgcaucuaccagauccuggccaucuacagcaccguggccuccagccuggugcucgucgugucccugggcgcgaucagcuucuggaugugcagcaacggcucccugcagugccggaucugcaucuga

SEQ ID NO: 70601 - RNA, 1701 nt, Artificial Sequence; identical to SEQ ID NO: 67823
  derived and/or modified sequence opt1 from hemagglutinin__InfluenzaA__AFN20000

SEQ ID NO: 70602 - RNA, 1701 nt, Artificial Sequence; identical to SEQ ID NO: 67830
  derived and/or modified sequence opt1 from hemagglutinin__InfluenzaA__AFN20006

SEQ ID NO: 70603 - RNA, 1701 nt, Artificial Sequence; identical to SEQ ID NO: 67462
  derived and/or modified sequence opt1 from hemagglutinin__InfluenzaA__AFN20012

SEQ ID NO: 70604 - RNA, 1701 nt, Artificial Sequence
  derived and/or modified sequence opt1 from hemagglutinin__InfluenzaA__AFN20018
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaacagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgcgaggagaucgacggcgugaagcuggagagcacccggaucuaccagauccuggccaucuacuccaccgucgccagcagccucgugcugguggucucccugggggccaucagcuucuggaugugcuccaacggcagccuccagugccgcaucugcaucuga

SEQ ID NO: 70605 - RNA, 1701 nt, Artificial Sequence; identical to SEQ ID NO: 67832
  derived and/or modified sequence opt1 from hemagglutinin__InfluenzaA__AFN20019

SEQ ID NO: 70606 - RNA, 1701 nt, Artificial Sequence; identical to SEQ ID NO: 67462
  derived and/or modified sequence opt1 from hemagglutinin__InfluenzaA__AFN20021

SEQ ID NO: 70607 - RNA, 1701 nt, Artificial Sequence; identical to SEQ ID NO: 67832
  derived and/or modified sequence opt1 from hemagglutinin__InfluenzaA__AFN20034

SEQ ID NO: 70608 - RNA, 1701 nt, Artificial Sequence; identical to SEQ ID NO: 67823
  derived and/or modified sequence opt1 from hemagglutinin__InfluenzaA__AFN20040

SEQ ID NO: 70609 - RNA, 1701 nt, Artificial Sequence; identical to SEQ ID NO: 70595
  derived and/or modified sequence opt1 from hemagglutinin__InfluenzaA__AFN20046

SEQ ID NO: 70610 - RNA, 1701 nt, Artificial Sequence; identical to SEQ ID NO: 67832
  derived and/or modified sequence opt1 from hemagglutinin__InfluenzaA__AFN20052

SEQ ID NO: 70611 - RNA, 1701 nt, Artificial Sequence; identical to SEQ ID NO: 67832
  derived and/or modified sequence opt1 from hemagglutinin__InfluenzaA__AFN20061

SEQ ID NO: 70612 - RNA, 1701 nt, Artificial Sequence
  derived and/or modified sequence opt1 from hemagglutinin__InfluenzaA__AFN20076
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggacugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 70613 - RNA, 1701 nt, Artificial Sequence
  derived and/or modified sequence opt1 from hemagglutinin__InfluenzaA__AFN20081
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucuccaagagcuacaucaacgacaagggcaaggaggugcugguccugugggggauccaccaccccagcaccacggccgaccagcagucccucuaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccuggugaucccccgguacgcguucgccauggagcgcaacgccgggagcggcaucaucaucuccgacacccccguccacgacugcaacaccacgugccagaccccgaagggcgccaucaacaccagccuccccuuccagaacauccaccccaucaccaucgggcggugccccaaguacgugaaguccacgaagcugcgccuggccaccggccuccggaacgugccgagcauccagucccgcgggcuguucggcgcgaucgccggguucaucgagggcggcuggaccgggauggucgacggcugguacggguaccaccaccagaacgagcagggcagcggguacgccgccgaccugaaguccacccagaacgccaucgacaagaucacgaacaaggugaacagcgugaucgagaagaugaacacccaguucaccgcggucggcaaggaguucaaccaccucgagaagcggaucgagaaccugaacaagaagguggacgacggcuuccuggacaucuggaccuacaacgccgagcuccugguccugcucgagaacgagcgcacgcuggacuaccacgacuccaacgugaagaaccuguacgagaaggugcggaaccagcucaagaacaacgccaaggagaccgggaacggcugcuucgaguucuaccacaagugcgacaacacgugcauggagagcgucaagaacgggaccuacgacuaccccaaguacuccgaggaggccaagcugaaccgcgaggugaucgacggcgugaagcuggagagcacccggaucuaccagauccucgccaucuacuccaccgucgcgagcucccuggugcugguggucagccucggggccaucagcuucuggaugugcuccaacggcagccugcagugccgcaucugcaucuga

SEQ ID NO: 70614 - RNA, 1701 nt, Artificial Sequence; identical to SEQ ID NO: 67832
  derived and/or modified sequence opt1 from hemagglutinin__InfluenzaA__AFN20092

SEQ ID NO: 70615 - RNA, 1701 nt, Artificial Sequence; identical to SEQ ID NO: 70594
  derived and/or modified sequence opt1 from hemagglutinin__InfluenzaA__AFN20099

SEQ ID NO: 70616 - RNA, 1701 nt, Artificial Sequence
  derived and/or modified sequence opt1 from hemagglutinin__InfluenzaA__AFN20112
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcaagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacaacccgaacaagggggucaccgccgccugcccccacgccggcgccaagagcuucuacaagaaccugaucuggcucgugaagaacgggaacuccuaccccaagcugaacaccagcuacaucaacgacaagggcaaggaggugcugguccucugggggauccaccaccccuccacgagcgccgaccagcagagccuguaccagaacgccgacgccuacgccuucgugggcaccucccgguacagcaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccagccugcccuuccagaacgugcaccccaucaccaucgggaagugccccaaguacgugaaguccaccaagcugcggcucgccacgggccugcgcaacgucccgagcauccagucccgggggcuguucggcgccaucgccggguucaucgagggcggcuggaccgggaugguggacggcugguacggguaccaccaccagaacgagcagggcagcggguacgccgcggaccucaaguccacccagaacgccuucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagacgaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccuccagccuggugcucguggucagccugggggccaucuccuucuggaugugcagcaacggcucccugcagugccggaucugcaucuga

SEQ ID NO: 70617 - RNA, 1701 nt, Artificial Sequence
  derived and/or modified sequence opt1 from hemagglutinin__InfluenzaA__AFN87924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaccuccuacaucaacgacaagcggaaggaggugcugguccucuggggcauccaccaccccagcacgagcgccgaccagcagucccuguaccagaacgccgacgccuacgccuucguggggaccagccgcuacuccaagaaguucaagccggagaucgcgauccggcccaaggugcgcgaccaggagggccggaugaacuacuacuggacccuggucgagcccggcgacaagaucaccuucgaggccacggggaaccucguggugccccgcuacgccuucgccauggagcggaacgccggcagcgggaucaucaucuccgacaccagcguccacgacugcaacacgaccugccagaccccgaagggcgcgaucaacaccucccugcccuuccagaacgugcaccccaucaccaucggcaagugccccaaguacgucaagagcaccaagcugcgccucgccacggggcugcggaacgugccguccauccagagccgcggccuguucggggccaucgccggcuucaucgagggcggguggaccggcaugguggacgggugguacggcuaccaccaccagaacgagcagggguccggcuacgccgcggaccucaagagcacccagaacgccuucgacaagaucaccaacaaggugaacuccgucaucgagaagaugaacacgcaguucaccgccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggcgaagcugaaccgcgaggagaucgacggggugaagcucgagagcacccggaucuaccagauccuggccaucuacuccaccgucgccagcagccuggugcucguggucucccugggcgccaucagcuucuggaugugcuccaacgggagccugcagugccgcaucugcaucuga

SEQ ID NO: 70618 - RNA, 1701 nt, Artificial Sequence; identical to SEQ ID NO: 63677
  derived and/or modified sequence opt1 from hemagglutinin__InfluenzaA__AFN87926

SEQ ID NO: 70619 - RNA, 1701 nt, Artificial Sequence
  derived and/or modified sequence opt1 from hemagglutinin__InfluenzaA__AFN87927
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagcggaaggaggugcugguccucuggggcauccaccaccccagcaccuccgccgaccagcagagccuguaccagaacgccgacgccuacguguucguggggacgucccgcuacagcaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcuccgggaucaucaucagcggcacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaaccgggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70620 - RNA, 1701 nt, Artificial Sequence
  derived and/or modified sequence opt1 from hemagglutinin__InfluenzaA__AFN87928
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucgccgugucccugggggccaucagcuucuggaugugcuccaacggcagccugcagugccgcaucugcaucuga

SEQ ID NO: 70621 - RNA, 1701 nt, Artificial Sequence; identical to SEQ ID NO: 64841
  derived and/or modified sequence opt1 from hemagglutinin__InfluenzaA__AFN87929

SEQ ID NO: 70622 - RNA, 1701 nt, Artificial Sequence; identical to SEQ ID NO: 64841
  derived and/or modified sequence opt1 from hemagglutinin__InfluenzaA__AFN87930

SEQ ID NO: 70623 - RNA, 1701 nt, Artificial Sequence
  derived and/or modified sequence opt1 from hemagglutinin__InfluenzaA__AFN87931
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggagaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagcaucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucacgauggagcgcaacgccggguccggcaucaucaucagcgacacccccgugcacgacugcaacacgaccugccagaccccgaagggcgccaucaacaccucccuccccuuccagaacauccaccccaucaccaucgggaagugccccaaguacgucaagagcaccaagcugcggcuggccacgggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacuccaccgucgcgagcagccuggugcugguggucucccucggggccaucagcuucuggaugugcuccaacggcagccugcagugccggaucugcaucuga

SEQ ID NO: 70624 - RNA, 1701 nt, Artificial Sequence
  derived and/or modified sequence opt1 from hemagglutinin__InfluenzaA__AFN87932
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 70625 - RNA, 1701 nt, Artificial Sequence; identical to SEQ ID NO: 64841
  derived and/or modified sequence opt1 from hemagglutinin__InfluenzaA__AFN87933

SEQ ID NO: 70626 - RNA, 1701 nt, Artificial Sequence
  derived and/or modified sequence opt1 from hemagglutinin__InfluenzaA__AFN87934
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcagcuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccagcgccgaccagcagucccucuaccagaacgccgacacguacguguucgugggcaccagccgguacuccaagaaguucaagcccgagaucgccauccgcccgaagguccgggaccaggaggggcgcaugaacuacuacuggacccugguggagcccggcgacaagaucaccuucgaggccacggggaaccugguggucccccgguacgcguucgccauggagcgcaacgccggcagcggcaucaucaucuccgacacccccgugcacgacugcaacacgaccugccagaccccgaagggggccaucaacaccagccuccccuuccagaacauccaccccaucaccaucggcaagugccccaaguacgugaaguccaccaagcugcggcuggccacggggcuccgcaacgucccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucaccaacaaggugaacagcgucaucgagaagaugaacacgcaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucagccucggcgccaucuccuucuggaugugcagcaacggcucccugcagugccggaucugcaucuga

SEQ ID NO: 70627 - RNA, 1701 nt, Artificial Sequence
  derived and/or modified sequence opt1 from hemagglutinin__InfluenzaA__AFN87936
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacagcuaccccaagcuguccaccagcuacaucaacgacaagggcaaggaggugcugguccucugggggauccaccaccccuccacgagcgccgaccagcagagccuguaccagaacgccgacgccuacgccuucgugggcaccucccgguacagcaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccagccugcccuuccagaacgugcaccccaucaccaucgggaagugccccaaguacgugaaguccaccaagcugcggcucgccacgggccugcgcaucgucccgagcauccagucccgggggcuguucggcgccaucgccggguucaucgagggcggcuggaccgggaugguggacggcugguacggguaccaccaccagaacgagcagggcagcggguacgccgcggaccucaaguccacccagaacgccuucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccuccagccuggugcucguggucagccugggggccaucuccuucuggaugugcagcaacggcucccugcagugccggaucugcaucuga

SEQ ID NO: 70628 - RNA, 1701 nt, Artificial Sequence
  derived and/or modified sequence opt1 from hemagglutinin__InfluenzaA__AFN87938
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagaccagcaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 70629 - RNA, 1701 nt, Artificial Sequence
  derived and/or modified sequence opt1 from hemagglutinin__InfluenzaA__AFN87939
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaccuccuacaucaacgacaagggcaaggaggugcugguccucugggggauccaccaccccagcacgagcgccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccgggagcggcaucaucaucuccgacaccagcguccacgacugcaacacgaccugccagaccccgaagggcgcgaucaacaccucccugcccuuccagaacgugcaccccaucaccaucgggaagugccccaaguacgucaagagcaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 70630 - RNA, 1701 nt, Artificial Sequence
  derived and/or modified sequence opt1 from hemagglutinin__InfluenzaA__AFN87941
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 70631 - RNA, 1701 nt, Artificial Sequence
  derived and/or modified sequence opt1 from hemagglutinin__InfluenzaA__AFN87943
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacagcuaccccaagcuguccaccagcuacaucaacgacaagggcaaggaggugcugguccucugggggauccaccaccccuccacgagcgccgaccagcagagccuguaccagaacgccgacgccuacgccuucgugggcaccucccgguacagcaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccagccugcccuuccagaacgugcaccccaucaccaucgggaagugccccaaguacgugaaguccaccaagcugcggcucgccacgggccugcgcaacgucccgagcauccagucccgggggcuguucggcgccaucgccggguucaucgagggcggcuggaccgggaugguggacggcugguacggguaccaccaccagaacgagcagggcagcggguacgccgcggaccucaaguccacccagaacgccaucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccuccagccuggugcucguggucagccugggggccaucuccuucuggaugugcagcaacggcucccugcagugccggaucugcaucuga

SEQ ID NO: 70632 - RNA, 1701 nt, Artificial Sequence
  derived and/or modified sequence opt1 from hemagglutinin__InfluenzaA__AFN87945
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70633 - RNA, 1701 nt, Artificial Sequence
  derived and/or modified sequence opt1 from hemagglutinin__InfluenzaA__AFN87947
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaccuccuacaucaacgacaagggcaaggaggugcugguccucugggggauccaccaccccagcacgagcgccgaccagcagucccuguaccagaacgccgacgccuacgccuucgugggcaccagccgguacuccaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccgggagcggcaucaucaucuccgacaccagcguccacgacugcaacacgaccugccagaccccgaagggcgcgaucaacaccucccugcccuuccagaacgugcaccccaucaccaucgggaagugccccaaguacgucaagagcaccaagcugcggcucgccacgggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacccagaacgccuucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 70634 - RNA, 1701 nt, Artificial Sequence
  derived and/or modified sequence opt1 from hemagglutinin__InfluenzaA__AFN87949
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccagcgccgaccagcagucccucuaccagaacgccgacacguacguguucgugggcaccagccgguacuccaagaaguucaagcccgagaucgccauccgcccgaagguccgggaccaggaggggcgcaugaacuacuacuggacccugguggagcccggcgacaagaucaccuucgaggccacggggaaccugguggucccccgguacgcguucgccauggagcgcaacgccggcagcggcaucaucaucuccgacacccccgugcacgacugcaacacgaccugccagaccccgaagggggccaucaacaccagccuccccuuccagaacauccaccccaucaccaucggcaagugccccaaguacgugaaguccaccaagcugcggcuggccacggggcuccgcaacgucccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucaccaacaaggugaacagcgucaucgagaagaugaacacgcaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucagccucggcgccaucuccuucuggaugugcagcaacggcucccugcagugccggaucugcaucuga

SEQ ID NO: 70635 - RNA, 1701 nt, Artificial Sequence; identical to SEQ ID NO: 67948
  derived and/or modified sequence opt1 from hemagglutinin__InfluenzaA__AFN87951

SEQ ID NO: 70636 - RNA, 1701 nt, Artificial Sequence
  derived and/or modified sequence opt1 from hemagglutinin__InfluenzaA__AFN87953
augaaggccauccuggugguccuccuguacaccuucgccaccgcgaacgccgacacgcugugcaucggcuaccacgccaacaacagcaccgacaccguggacaccgugcucgagaagaacgucacggugacccacuccgccaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgaccugaacaagggggugaccgccgccugcccgcacgcgggcgccaagagcuucuacaagaaccucaucuggcuggucaagaaggggaacuccuaccccaagcugagcaaguccuacaucaacgacaagggcaaggaggugcucgugcugugggggauccaccaccccagcaccagcgccgaccagcagucccuguaccagaacgccgacgccuacgucuucgugggcacgagccgguacuccaagaaguucaagcccgagaucgcgauccgcccgaaggugcgggaccaggagggccgcaugaacuacuacuggacccucgucgagcccggggacaagaucaccuucgaggccaccggcaaccugguggugccccgguacgccuucgccauggagcgcaacgccgggagcggcaucaucaucuccgacacgcccguccacgacugcaacacgaccugccagaccccgaagggcgcgaucaacaccagccugcccuuccagaacauccaccccaucaccaucgggaagugccccaaguacgugaaguccaccaagcuccggcuggccaccggccugcgcaacgugccgagcauccagucccggggccucuucggggccaucgccggguucaucgagggcggcuggacggggauggucgacggcugguacggguaccaccaccagaacgagcagggcagcggguacgccgcggaccugaaguccacccagaacgccaucgacgagaucaccaacaaggugaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggcgaagcucaaccgggaggagaucgacggcgugaagcuggaguccacccgcaucuaccagauccuggccaucuacagcaccguggccuccagccucguccugguggugagccugggggccaucuccuucuggaugugcagcaacggcucccuccagugccggaucugcaucuga

SEQ ID NO: 70637 - RNA, 1701 nt, Artificial Sequence
  derived and/or modified sequence opt1 from hemagglutinin__InfluenzaA__AFN87955
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgucgcgagcucccuggugcugguggucagccucggcgccaucagcuucuggaugugcuccaacggcagccugcagugccggaucugcaucuga

SEQ ID NO: 70638 - RNA, 1701 nt, Artificial Sequence
  derived and/or modified sequence opt1 from hemagglutinin__InfluenzaA__AFN87957
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaucagcgacaacggcacgugcuaccccggcgacuucaucgacuacgaggagcuccgggagcagcuguccagcguguccagcuucgagcgcuucgagaucuuccccaagaccuccagcuggcccaaccacgacccgaacaagggggucaccgccgccugcccccacgccggcgcgaaguccuucuacaagaaccugaucuggcucgugaagaaggggaacagcuaccccaagcuguccaccagcuacaucaacgacaagggcaaggaggugcugguccucugggggauccaccaccccuccacgagcgccgaccagcagagccuguaccagaacgccgacgccuacgccuucgugggcaccucccgguacagcaagaaguucaagccggagaucgcgauccgccccaaggugcgggaccaggagggccgcaugaacuacuacuggacccuggucgagcccggggacaagaucaccuucgaggccacgggcaaccucguggugccccgguacgccuucgccauggagcgcaacgccggguccggcaucaucaucagcgacaccuccguccacgacugcaacacgaccugccagaccccgaagggcgcgaucaacaccagccugcccuuccagaacgugcaccccaucaccaucgggaagugccccaaguacgugaaguccaccaagcugcggcucgccacgggccugcgcaacgucccgagcauccagucccgggggcuguucggcgccaucgccggguucaucgagggcggcuggaccgggaugguggacggcugguacggguaccaccaccagaacgagcagggcagcggguacgccgcggaccucaaguccacccagaacgccuucgacgagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacaagugcauggaguccgugaagaacgggacguacgacuaccccaaguacagcgaggaggcgaagcugaaccgggaggagaucgacggcgugaagcucgaguccacccgcaucuaccagauccuggccaucuacagcaccgucgccuccagccuggugcucguggucagccugggggccaucuccuucuggaugugcagcaacggcucccugcagugccggaucugcaucuga

SEQ ID NO: 70639 - RNA, 1701 nt, Artificial Sequence
  derived and/or modified sequence opt1 from hemagglutinin__InfluenzaA__AFN87959
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccagcaccagcgccgaccagcagucccucuaccagaacgccgacacguacguguucgugggcaccagccgguacuccaagaaguucaagcccgagaucgccauccgcccgaagguccgggaccaggaggggcgcaugaacuacuacuggacccugguggagcccggcgacaagaucaccuucgaggccacggggaaccugguggucccccgguacgcguucgccauggagcgcaacgccggcagcggcaucaucaucuccgacacccccgugcacgacugcaacacgaccugccagaccccgaagggggccaucaacaccagccuccccuuccagaacauccaccccaucaccaucggcaagugccccaaguacgugaaguccaccaagcugcggcuggccacggggcuccgcaacgucccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucaccaacaaggugaacagcgucaucgagaagaugaacacgcaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgucgcgagcucccuggugcugguggucagccucggcgccaucagcuucuggaugugcuccaacggcagccugcagugccggaucugcaucuga

SEQ ID NO: 70640 - RNA, 1701 nt, Artificial Sequence; identical to SEQ ID NO: 64162
  derived and/or modified sequence opt1 from hemagglutinin__InfluenzaA__AFN87961

SEQ ID NO: 70641 - RNA, 1698 nt, Artificial Sequence
  derived and/or modified sequence opt1 from hemagglutinin__InfluenzaA__AFO64802
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgugaagaacgggcuguaccccaaccugagcaaguccuacgugaacaacaagggcaaggagguccucgugcuguggggcgugcaccaccccagcaacauccgggaccagcgcgccaucuaccacacggagaacgccuacgucagcgugguguccagccacuacucccggcgcuucaccccggagaucgccaagcggcccaagguccgcgaccaggaggggcggaucaacuacuacuggacccugcucgagcccggcgacaccaucaucuucgaggcgaacgggaaccugaucgcccccugguacgccuucgcccugagccgcggcuucggguccggcaucaucacgagcaacgccccgauggacgagugcgacgcgaagugccagacgccccagggcgccaucaacuccagccuccccuuccagaacgugcaccccgugaccaucggggagugcccgaaguacguccgguccgccaagcugcgcauggugaccggccugcggaacauccccagcauccagucccgcggccucuucggggccaucgccggguucaucgagggcggcuggaccgggaugaucgacggcugguacggguaccaccaccagaacgagcagggcagcggguacgcggccgaccagaaguccacccagaacgccaucaacggcaucaccaacaaggugaacagcgucaucgagaagaugaacacccaguucacggccgugggcaaggaguucaacaagcuggagcggcgcauggagaaccugaacaagaaggucgacgacggguuccucgacaucuggaccuacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcucgagagcaugggcgucuaccagauccuggccaucuacagcacgguggccuccagccuggugcuccuggucucccugggcgccaucagcuucuggaugugcuccaacgggagccuccagugccggaucugcaucuga

SEQ ID NO: 70642 - RNA, 1701 nt, Artificial Sequence
  derived and/or modified sequence opt1 from hemagglutinin__InfluenzaA__AFO64813
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggggugaccgccuccugcagccacaagggccgguccagcuucuaccgcaaccugcucuggcugaccgagaagaacggguccuaccccaaccugagcaagagcuacgugaacaacaaggagaaggagguccucgugcuguggggcgugcaccaccccuccaacauccgggaccagcgcgccaucuaccacacggagaacgcguacgucagcgugguguccagccacuacaaccggcgcuucacccccgagaucgccaagcggccgaagguccgcgaccaggaggggcggaucaacuacuacuggacccugcucgagcccggcgacaccaucaucuucgaggccaacggcaaccugaucgcccccugguacgccuucgcgcugucccgcggguucggcagcgggaucaucacguccaacgccagcauggacgagugcgacgccaagugccagacgccccagggcgccaucaacuccagccucccguuccagaacgugcaccccgugaccaucggcgagugccccaaguacguccgguccaccaagcugcgcauggugaccgggcugcggaacauccccagcauccagucccgcggccucuucggggccaucgcgggcuucaucgagggcggcuggaccggcaugaucgacgggugguacggcuaccaccaccagaacgagcaggggagcggcuacgccgccgaccagaaguccacccagaacgccaucaacgggaucaccaacaaggugaacagcgucaucgagaagaugaacacgcaguucaccgccgugggcaaggaguucaacaagcuggagcggcgcauggagaaccugaacaagaagguggacgacggcuuccucgacaucuggaccuacaacgcggagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacaacgagugcauggaguccgugaagaacgggacguacgacuacccgaaguacagcgaggagagcaagcugaaccgcgagaagaucgacggcgugaagcucgaguccaugggggucuaccagauccuggccaucuacagcaccguggccuccagccuggugcuccuggucucccugggcgccaucagcuucuggaugugcuccaacggcagccuccagugccggaucugcaucuga

SEQ ID NO: 70643 - RNA, 1701 nt, Artificial Sequence
  derived and/or modified sequence opt1 from hemagglutinin__InfluenzaA__AFO64824
augaaggccauccugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggcgugaccgccuccugcagccacaagggccgguccagcuucuaccgcaaccugcucuggcugaccgagaagaacgggcuguaccccaaccucuccaagagcuacgugaacaacaaggagaaggagguccuggugcuguggggcgugcaccaccccagcaacaucggggaccagcgggccaucuaccacacggagaacgcguacgucuccguggugagcucccacuacaaccgccgguucacccccgagaucgccaagcgcccgaagguccggggccaggagggccgcaucaacuacuacuggacccuccuggagcccggggacaccaucaucuucgaggccaacggcaaccugaucgcccccugguacgccuucgcgcucagccggggguucggcuccggcaucaucacgagcaacgccuccauggacgagugcgacgccaagugccagacgccccagggggccaucaacagcucccugccguuccagaacgugcaccccgugaccaucggcgagugccccaaguacguccgcagcaccaagcugaagauggugaccgggcuccggaacauccccuccauccagagccgcggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucaccaacaaggugaacagcgucaucgagaagaugaacacgcaguucaccgccguggggaaggaguucaacaagcuggagaagcggauggagaaccucaacaagaagguggacgacggcuuccuggacaucuggaccuacaacgcggagcugcucguccugcuggagaacgagcgcacccucgacuuccacgacagcaacgugaagaaccuguacgagaaggucaagaaccagcugaagaacaacgccaaggagaucgggaacggcugcuucgaguucuaccacaagugcaacaacgagugcauggaguccgugaagaacgggacguacgacuacccgaaguacagcgaggaguccaagcucaaccgggagaagaucgacggcgugaagcuggagagcaugggcgucuaccagauccuggccaucuacagcaccguggccuccagccucgugcugcuggucucccucggggccaucagcuucuggaugugcuccaacggcagccugcagugccgcaucugcaucuga

SEQ ID NO: 70644 - RNA, 1701 nt, Artificial Sequence
  derived and/or modified sequence opt1 from hemagglutinin__InfluenzaA__AFO64835
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaaggagagcugguccuacaucgccgagacccccgaccccgagaacgggaccugcuaccccggcuacuucgccgacuacgaggagcuccgggagcagcugagcuccgucagcuccuucgagcgcuucgagaucuucccgaaggagagcuccuggcccaaccacacggugaccaagggcgugaccgccagcugcucccacaacggcaagagcuccuucuaccggaaccugcucuggcugaccaagaagaacgggcuguaccccaaccucagcaaguccuacgucaacaacaaggagaaggaggugcuggugcuguggggcguccaccaccccagcaacaucggggagcagcgcgccaucuaccacacggagaacgcguacgugagcguggucuccagccacuacucccggcgcuucaccccggagaucgccaagcggcccaaggugcgcgaccaggagggccggaucaacuacuacuggacccuccuggagcccggcgacaccaucaucuucgaggccaacgggaaccugaucgcccccugguacgccuucgcgcucagccgcggcuucggguccggcaucaucacgagcaacgccuccauggacgagugcgacgccaagugccagaccccgcagggcgccaucaacagcucccugcccuuccagaacgugcaccccgucaccaucggggagugccccaaguacgugcggagcaccaagcugcgcauggugacgggccuccggaacaucccguccauccagagccgcgggcuguucggcgccaucgcgggguucaucgagggcggcuggaccgggaugaucgacggcugguacggguaccaccaccagaacgagcagggcuccggguacgccgccgaccagaaguccacccagaacgccaucaacggcaucaccaacaaggucaacagcgugaucgagaagaugaacacgcaguucaccgccgugggcaaggaguucaacaagcuggagcggcgcauggagaaccucaacaagaaggucgacgacggguuccuggacaucuggaccuacaacgcggagcugcucgugcugcuggagaacgagcggacccucgacuuccacgacagcaacgucaagaaccuguacgagaaggugaagaaccagcugaagaacaacgccaaggagaucggcaacgggugcuucgaguucuaccacaagugcaacaacgagugcauggaguccgugaagaacggcacguacgacuaccccaaguacagcgaggaguccaagcucaaccgcgagaagaucgacggggucaagcuggagagcaugggcguguaccagauccuggccaucuacagcaccguggccuccagccucguccugcuggugucccucggcgccaucagcuucuggaugugcuccaacgggagccugcagugccggaucugcaucuga

SEQ ID NO: 70645 - RNA, 1701 nt, Artificial Sequence
  derived and/or modified sequence opt1 from hemagglutinin__InfluenzaA__AFO64846
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucaccaaggaguccuggagcuacaucgccgagacccccaaccccgagaacggcacgugcuaccccggcuacuucgccgacuacgaggagcuccgggagcagcuguccagcgucuccagcuucgagcgcuucgagaucuucccgaaggaguccagcuggcccaaccacaccgugaccaagggggugaccgccuccugcagccacaacggcaaguccagcuucuaccggaaccugcucuggcugacggagaagaacgggcuguaccccaaccucuccaagagcuacgucaacaacaaggagaaggaggugcuggugcuguggggcguccaccaccccuccaacaugggggaccagcgcgccaucuaccacaccgagaacgcguacgugagcguggucagcucccacuacagccggcgcuucaccccggagaucgccaagcggcccaaggugcgcggccaggagggccggaucaacuacuacuggacccuccuggagcccggggacacgaucaucuucgaggccaacggcaaccugaucgcgccccgcuacgccuucgcccucucccggggguucggcagcggcaucaucaccuccaacgccagcauggacgagugcgacgccaagugccagaccccgcagggggccaucaacuccagccugcccuuccagaacgugcaccccgucaccaucggcgagugccccaaguacgugcgcuccacgaagcugcggauggugaccgggcuccgcaacaucccgagcauccagucccggggccuguucggggccaucgcgggcuucaucgagggcggguggaccggcaugaucgacgggugguacggcuaccaccaccagaacgagcaggggagcggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacuccaacgucaagaaccuguacgagaaggucaagagccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgugaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 70646 - RNA, 1701 nt, Artificial Sequence
  derived and/or modified sequence opt1 from hemagglutinin__InfluenzaA__AFO64857
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcggggccaggagggccgcaucaacuacuacuggacccuccuggagcccggggacacgaucaucuucgaggccaacggcaaccugaucgcccccugguacgccuucgcgcucagccggggguucggcuccggcaucaucaccagcaccgccuccaugggggagugcgacgccaagugccagaccccgcagggcgccaucaacagcucccugcccuuccagaacgugcaccccgucacgaucggggagugccccaaguacgugcgcagcaccaagcugcggauggugaccggccuccgcaacaucccguccauccagagccgggggcuguucggcgccaucgcgggcuucaucgagggcggguggaccgggaugaucgacggcugguacggguaccaccaccagaacgagcagggcuccggcuacgccgccgaccagaaguccacgcagaacgccaucgacgggaucaccaacaaggucaacagcgugaucgagaagaugaacacccaguucaccgccgugggcaaggaguucaacaagcuggagcgccggauggagaaccucaacaagaaggucgacgacggguuccuggacaucuggacguacaacgcggagcugcucgugcugcuggagaacggccgcacccucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacggcaccuacgacuaccccaaguacagcgaggaguccaagcucaaccgggagaagaucgacggggucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 70647 - RNA, 1701 nt, Artificial Sequence
  derived and/or modified sequence opt1 from hemagglutinin__InfluenzaA__AFO64868
augaaggugaagcugcucguccugcugugcgccuucaccgccaccuacgcggacacgaucugcaucggcuaccacgccaacaacagcaccgacaccguggacaccgugcucgagaagaacgucacggugacccacuccgugaaccugcuggaggacagccacaacgggaagcucugccgccugaagggcaccgcgccccugcagcucgggaacugcuccgucgccggcuggauccuggggaacccggagugcgagagccuguucuccaaggagagcugguccuacaucgccgagacccccaaccccgagaacggcacgugcuaccccggcugcuucgccgacuacgaggagcuccgggagcagcugagcuccgugagcuccuucgagcgcuucgagaucuucccgaaggagagcuccuggcccaaccacaccgugaccaagggggucaccgccagcugcucccacaacggcaagagcuccuucuacaagaaccugcucuggcugacggagaagaacgggcuguaccccaaccucagcaaguccuacgugaacaacaaggagaaggaggugcugguccuguggggcgugcaccaccccagcaacauccgggaccagcgcgccaucuaccacaccgagaacgccuacgugagcgucguguccagccacuacucccggcgcuucaccccggagaucgcgaagcggcccaaggugcgcgggcaggagggccggaucaacuacuacuggacccuccuggagcccggcgacacgaucaucuucgaggccaacgggaaccugaucgcccccugguacgccuucgcccucagccgcggcuucggguccggcaucaucaccagcaacgcguccaugggcgagugcgacgccaagugccagaccccgcagggggccaucaacagcucccugcccuuccagaacguccaccccgugaccaucggcgagugccccaaguacgugcggagcacgaagcugcgcauggucaccgggcuccggaacaucccguccauccagagccgcggccuguucggggccaucgccggcuucaucgagggcggguggaccggcaugaucgacgggugguacggcuaccaccaccagaacgagcagggguccggcuacgcggccgaccagaaguccacccagaacgccaucgacggcaucacgaacaaggugaacagcgugaucgagaagaugaacacccaguucaccgccgucgggaaggaguucaacaagcuggagcggcgcauggagaaccucaacaagaagguggacgacggcuuccuggacaucuggaccuacaacgccgagcugcucguccugcuggagaacgagcggacgcucgacuuccacgacagcaacgugaagaaccuguacgagaaggugaagaaccagcugaagaacaacgcgaaggagaucgggaacggcugcuucgaguucuaccacaagugcaacaacgagugcauggaguccgucaagaacgggaccuacgacuaccccaaguacagcgaggaguccaagcucaaccgcgagaagaucgacggcgugaagcuggagagcaugggcguguaccagauccuggccaucuacagcaccgucgccuccagccucgugcugcuggugucccucggggccaucagcuucuggaugugcuccaacggcagccugcagugccggaucugcaucuga

SEQ ID NO: 70648 - RNA, 1698 nt, Artificial Sequence
  derived and/or modified sequence opt1 from hemagglutinin__InfluenzaA__AFO64879
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuucaaggaguccuggagcuacaucgucgagacccccaaccccgagaacggcacgugcuaccccggcuacuucgccgacuacgaggagcugcgcgagcagcuguccagcguguccagcuucgagcgguucgagaucuucccgaaggaguccagcuggcccaaccacaccgugaccggggucuccgccagcugcucccacaacggcaagagcuccuucuaccgcaaccuccuguggcugaccgagaagaacgggcucuaccccaaccugagcaaguccuacgugaacaacaaggagaaggaggugcugguccucuggggcgugcaccaccccagcaacauccgggaccagcgcgccaucuaccacacggagaacgccuacgugagcgucguguccagccacuacucccggcgcuucaccccggagaucgccaagcggcccaaggugcgcgggcaggagggccggaucaacuacuacuggacccugcuggagcccggcgacaccaucaucuucgaggcgaacgggaaccucaucgcccccugguacgccuucgcccugagccgcggcuucggguccggcaucaucacgagcaacgccccgauggacgagugcgacgcgaagugccagacgccccagggcgccaucaacuccagccugcccuuccagaacguccaccccgugaccaucggggagugcccgaaguacgugcgguccgccaagcuccgcauggucaccggccugcggaacauccccagcauccagucccgcgggcuguucggcgccaucgccggguucaucgagggcggcuggaccgggaugaucgacggcugguacggguaccaccaccagaacgagcagggcagcggguacgcggccgaccagaaguccacccagaacgccaucaacggcaucaccaacaaggugaacagcgugaucgagaagaugaacacccaguucacggccgucggcaaggaguucaacaagcucgagcggcgcauggagaaccugaacaagaagguggacgacggguuccuggacaucuggaccuacaacgccgagcuccugguccugcucgagaacgagcggacccuggacuuccacgacuccaacgugaagaaccuguacgagaaggucaagagccagcucaagaacaacgcgaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcuggagagcaugggcguguaccagauccucgccaucuacagcacggucgccuccagccuggugcugcucgugucccugggcgccaucagcuucuggaugugcuccaacgggagccugcagugccggaucugcaucuga

SEQ ID NO: 70649 - RNA, 1698 nt, Artificial Sequence
  derived and/or modified sequence opt1 from hemagglutinin__InfluenzaA__AFO64890
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacauccgggaccagcgcgccaucuaccacacggagaacgccuacguguccgucgugagcucccacuacagccggcgcuucaccccggagaucgccaagcggcccaaggugcgcgggcaggagggccggaucaacuacuacuggacccugcuggagcccggcgacaccaucaucuucgaggcgaacgggaaccucaucgcccccugguacgccuucgcccugucccgcggcuucgggagcggcaucaucacguccaacgccccgauggacgagugcgacgucaagugccagacgccccagggcgcgaucaacagcucccugcccuuccagaacgugcaccccgugaccaucggggagugcccgaaguacguccggagcgccaagcuccgcauggugaccggccugcggaacauccccuccauccagagccgcgggcuguucggcgccaucgccggguucaucgagggcggcuggaccgggaugaucgacggcugguacggguaccaccaccagaacgagcagggcuccggguacgccgcggaccagaaguccacccagaacgccaucaacggcaucaccaacaaggugaacagcgucaucgagaagaugaacacccaguucacggccgugggcaaggaguucaacaagcucgagcggcgcauggagaaccugaacaagaaggucgacgacggguuccuggacaucuggaccuacaacgccgagcuccuggugcugcucgagaacgagcggacccuggacuuccacgacagcaacgugaagaaccuguacgagaaggucaagucccagcucaagaacaacgccaaggagaucggcaacgggugcuucgaguucuaccacaagugcaacaacgagugcauggagagcgugaagaacggcaccuacgacuaccccaaguacuccgaggagagcaagcugaaccgcgagaagaucgacggggugaagcuggagagcaugggcgucuaccagauccucgcgaucuacuccacgguggccagcucccuggugcugcucgucagccugggcgccaucuccuucuggaugugcagcaacgggucccugcagugccggaucugcaucuga

SEQ ID NO: 70650 - RNA, 1701 nt, Artificial Sequence
  derived and/or modified sequence opt1 from hemagglutinin__InfluenzaA__AFO64901
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgugagcuccuucgagcgcuucgagaucuucccgaaggagagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaacaagaagaaggagguccuggugcuguggggcgugcaccaccccagcaacaucggggaccagcgggccaucuaccacaccgagaacgcguacgucagcgugguguccagccacuacucccgccgguucaccccggagaucgccaagcgccccaagguccggaaccaggagggccgcaucaacuacuacuggacccuccuggagcccggcgacacgaucaucuucgaggccaacgggaaccugaucgcccccugguacgccuucgcgcucagccggggcuucgaguccgggaucaucaccagcaacgccuccaugggcgagugcgacgccaagugccagaccccgcagggcgccaucaacagcucccugcccuuccagaacgugcaccccgugaccaucggggagugccccaaguacguccgcagcacgaagcugcggauggugaccggccuccgcaacaucccguccauccagagccgggggcuguucggcgccaucgcgggguucaucgagggcggcuggaccgggaugaucgacggcugguacggguaccaccaccagaacgagcagggcuccggguacgccgccgaccagaaguccacccagaacgccaucaacggcaucacgaacaaggugaacagcaucaucgagaagaugaacacccaguucaccgccgucggcaaggaguucaacaagcuggagcgccggauggagaaccucaacaagaagguggacgacggguuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucggcaacgggugcuucgaguucuaccacaagugcaacaacgagugcauggaguccgucaagaacggcaccuacgacuaccccaaguacagcaaggaguccaagcucaaccgggagaagaucgacggggugaagcuggagagcaugggcguguaccagauccuggccaucuacagcaccgucgccuccagccucgugcugcuggugucccucggcgccaucagcuucuggaugugcuccaacgggagccugcagugccgcaucugcaucuga

SEQ ID NO: 70651 - RNA, 1698 nt, Artificial Sequence
  derived and/or modified sequence opt1 from hemagglutinin__InfluenzaA__AFO65016
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccaagaagaacgggcucuaccccaaccuguccaagagcuacgugaacaacaaggagaaggaggugcugguccucuggggcgugcaccaccccagcaacaucggggaccagcggacgaucuaccacaccgagaacgccuacguguccgucgugagcucccacuacagccgccgguucaccccggagaucgccaagcgccccaaggugcgggaccaggagggccgcaucaacuacuacuggacccugcuggagcccggcgacacgaucaucuucgaggccaacgggaaccucaucgcgcccugguacgccuucgcccugucccggggcuucgggagcggcaucaucaccuccaacgccccgauggacgagugcgacgccaagugccagacgccccagggcgcgaucaacagcucccugcccuuccagaacguccaccccaucaccaucggggagugcccgaaguacgugcgcagcgccaagcuccggauggugaccggccugcgcaacauccccuccauccagagccgggggcuguucggcgccaucgccggguucaucgagggcggcuggaccgggaugaucgacggcugguacggguaccaccaccagaacgagcagggcuccggguacgccgcggaccagaaguccacccagaacgccaucaacggcaucaccaacaaggucaacagcgugaucgagaagaugaacacgcaguucaccgccgugggcaaggaguucaacaaccucgagcgccggauggagaaccugaacaagaaggucgacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcaacaacgagugcauggagagcgugaagaacggcacguacgacuaccccaaguacuccgaggagagcaagcugaaccgggagaagaucgacggggucaagcuggagagcaugggcguguaccagauccucgcgaucuacuccaccguggccagcucccugguccugcucgugagccugggcgccaucuccuucuggaugugcagcaacgggucccugcagugccgcaucugcaucuga

SEQ ID NO: 70652 - RNA, 1698 nt, Artificial Sequence; identical to SEQ ID NO: 63123
  derived and/or modified sequence opt1 from hemagglutinin__InfluenzaA__AFO65027

SEQ ID NO: 70653 - RNA, 1698 nt, Artificial Sequence
  derived and/or modified sequence opt1 from hemagglutinin__InfluenzaA__AFO65038
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 70654 - RNA, 1698 nt, Artificial Sequence
  derived and/or modified sequence opt1 from hemagglutinin__InfluenzaA__AFO66136
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 70655 - RNA, 1701 nt, Artificial Sequence
  derived and/or modified sequence opt1 from hemagglutinin__InfluenzaA__AFO66147
augaaggccaagcugcucgugcugcugugcgccuucaccaccacguacgcggacaccaucugcaucggcuaccacgccaacaacagcaccgacaccgucgacacggugcucgagaagaacgugaccgucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacgcccaaccccaagaacgggaccugcuaccccggcuacuucgccgacuacgaggagcuccgggagcagcugagcuccgugagcuccuucgagcgcuucgagaucuucccgaaggacagcuccuggcccaaccacaccgucaccaagggcgugacggccagcugcucccacaacggcaagagcuccuucuacaagaaccugcucuggcugaccgggaagaacggccuguaccccaaccucagcaaguccuacgugaacaagaaggggaaggagguccuggugcuguggggcgugcaccaccccagcaacaugggcgaccagcgggccaucuaccacaaggagaacgccuacgucagcgugcucuccagccacuacucccgccgguucaccccggagaucgcgaagcgccccaaggugcgggaccaggaggggcgcaucaacuacuacuggacccugcuggagcccggcgacacgaucaucuucgaggccaacgggaaccucaucgcccccugguacgccuucgcccugagccggggcuucggcuccgggaucaucaucagcaacgcguccaugggcgagugcgacgccaagugccagaccccgcagggggccaucaacagcucccugcccuuccagaacguccaccccgugaccaucggcgagugccccaaguacgugcgcagcaccaagcuccggauggucacggggcugcgcaacgugccguccauccagagccggggccuguucggcgccaucgccggguucaucgagggcggguggaccggcaugaucgacgggugguacggcuaccaccaccagaacgagcagggcuccggguacgcggccgaccagaaguccacccagaacgccaucaacggcaucaccaacaaggugaacagcaucaucgagaagaugaacacgcaguucaccgccgucgggaaggaguucaacaagcucgagcgccggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagaaccagcucaagaacaacgcgaaggagaucgggaacggcugcuucgaguucuaccacaagugcaacaacgagugcauggaguccgucaagaacggcacguacgacuaccccaaguacagcaaggaguccaagcugaaccgggagaagaucgacggggugaagcuggagagcaugggcguguaccagauccucgccaucuacagcaccgucgccuccagccuggugcugcucgugucccugggggccaucagcuucuggaugugcuccaacggcagccugcagugccgcaucugcaucuga

SEQ ID NO: 70656 - RNA, 1698 nt, Artificial Sequence
  derived and/or modified sequence opt1 from hemagglutinin__InfluenzaA__AFO66158
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagggcuccuggagcuacaucgucgagacccccaaccccgagaacggcacgugcuaccccggguacuucgccgacuacgaggagcugcgcgagcagcucuccagcguguccagcuucgagcgguucgagaucuucccgaagggcuccagcuggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 70657 - RNA, 1698 nt, Artificial Sequence
  derived and/or modified sequence opt1 from hemagglutinin__InfluenzaA__AFO66169
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaccuccaaccccgagaacggcacgugcuaccccggcuacuucaccgacuacgaggagcugcgcgagcagcucagcuccgugagcuccuucgagcgguucgagaucuuccccaaggagagcuccuggccgaaccacaccgucaccggggugagcgccuccugcagccacaacggcaaguccagcuucuacaagaaccugcuguggcucacggggaagaacggccuguaccccaaccuguccaagagcuacgccaacaacaaggagaaggaggugcucguccuguggggcgugcaccacccgcccaacaucggggaccagcgcgcccuguaccacaccgagaacgccuacgugagcgucguguccagccacuacucccggcgcuucacccccgagaucgccaagcggcccaaggugcgcgaccaggagggccggaucaacuacuacuggacccuccuggagcccggggacacgaucaucuucgaggccaacggcaaccugaucgcgccccgcuacgccuucgcccucagccggggguucggcuccggcaucaucaccagcaacgccccgauggacgagugcgacgccaagugccagacgccccacggggcgaucaacuccagccugcccuuccagaacguccaccccgugaccaucggcgagugcccgaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcugaaccgggagaagaucgacggcgugaagcucgagagcaugggcgucuaccagauccuggcgaucuacagcaccguggccuccagccuggugcuccuggucucccugggggccaucagcuucuggaugugcuccaacggcagccuccagugccgcaucugcaucuga

SEQ ID NO: 70658 - RNA, 1698 nt, Artificial Sequence
  derived and/or modified sequence opt1 from hemagglutinin__InfluenzaA__AFO66180
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcggaaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 70659 - RNA, 1698 nt, Artificial Sequence
  derived and/or modified sequence opt1 from hemagglutinin__InfluenzaA__AFO66191
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 70660 - RNA, 1698 nt, Artificial Sequence; identical to SEQ ID NO: 61520
  derived and/or modified sequence opt1 from hemagglutinin__InfluenzaA__AFO66202

SEQ ID NO: 70661 - RNA, 1698 nt, Artificial Sequence
  derived and/or modified sequence opt1 from hemagglutinin__InfluenzaA__AFO66213
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaagaagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 70662 - RNA, 1698 nt, Artificial Sequence
  derived and/or modified sequence opt1 from hemagglutinin__InfluenzaA__AFO66224
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 70663 - RNA, 1698 nt, Artificial Sequence
  derived and/or modified sequence opt1 from hemagglutinin__InfluenzaA__AFO66235
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgugcagcgcgcccuguaccacaccgagaacgccuacgucagcguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 70664 - RNA, 1698 nt, Artificial Sequence
  derived and/or modified sequence opt1 from hemagglutinin__InfluenzaA__AFO66246
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcaaccagcgcgcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcggagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 70665 - RNA, 1701 nt, Artificial Sequence
  derived and/or modified sequence opt1 from hemagglutinin__InfluenzaA__AFP33324
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacgcccaaccccaagaacgggaccugcuaccccggcuacuucgccgacuacgaggagcuccgggagcagcugagcuccgugagcuccuucgagcgcuucgagaucuucccgaaggacagcuccuggcccaaccacaccgucaccaagggcgugacggccagcugcucccacaacggcaagagcuccuucuacaagaaccugcucuggcugaccgggaagaacggccuguaccccaaccucagcaaguccuacgugaacaagaaggggaaggagguccuggugcuguggggcgugcaccaccccagcaacaugggcgaccagcgggccaucuaccacaaggagaacgccuacgucagcgugcucuccagccacuacucccgccgguucaccccggagaucgcgaagcgccccaaggugcgggaccaggaggggcgcaucaacuacuacuggacccugcuggagcccggcgacacgaucaucuucgaggccaacgggaaccucaucgcccccugguacgccuucgcccugagccggggcuucggcuccgggaucaucaucagcaacgcguccaugggcgagugcgacgccaagugccagaccccgcagggggccaucaacagcucccugcccuuccagaacguccaccccgugaccaucggcgagugccccaaguacgugcgcagcaccaagcuccggauggucacggggcugcgcaacgugccguccauccagagccggggccuguucggcgccaucgccggguucaucgagggcggguggaccggcaugaucgacgggugguacggcuaccaccaccagaacgagcagggcuccggguacgcggccgaccagaaguccacccagaacgccaucaacggcaucaccaacaaggugaacagcaucaucgagaagaugaacacgcaguucaccgccgucgggaaggaguucaacaagcucgagcgccggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagacgcagcucaagaacaacgcgaaggagaucgggaacggcugcuucgaguucuaccacaagugcaacaacgagugcauggaguccgucaagaacggcaccuacgacuaccccaaguacagcaaggaguccaagcugaaccgggagaagaucgacggggugaagcuggagagcaugggcguguaccagauccucgccaucuacagcaccgucgccuccagccuggugcugcucgugucccugggggccaucagcuucuggaugugcuccaacggcagccugcagugccgcaucugcaucuga

SEQ ID NO: 70666 - RNA, 1698 nt, Artificial Sequence
  derived and/or modified sequence opt1 from hemagglutinin__InfluenzaA__AFP33325
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugauccccaaggagagcugguccuacaucguggagacccccaaccccgagaacggcacgugcuacccgggcuacuucgccgacuacgaggagcugcgcgagcagcucagcuccgugagcuccuucgagcgguucgagaucuuccccaaggagagcuccuggcccagccacaccgucaccgggguguccgccagcugcucccacaacggcaagagcuccuucuaccgcaaccugcuguggcucaccgggaagaacggccuguaccccaaccugagcaaguccuacagcaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcggggccaggaggggcgcaucaacuacuacuggacccuccuggagccgggcgacaccaucaucuucgaggccaacgggaaccugaucgcgcccugguacgccuucgcccucagccggggcuucggcuccgggaucaucacgagcaacgcccccauggacgagugcgacgccaagugccagacgccccagggcgcgaucaacuccagccugccguuccagaacguccaccccgugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcaccuacgacuacccgaaguacagcgaggaguccaagcucaaccgggagaagaucgacggcgugaagcuggagagcaugggggucuaccagauccuggcgaucuacagcacgguggccuccagccucgugcugcuggucucccucggcgccaucagcuucuggaugugcuccaacgggagccugcagugccgcaucugcaucuga

SEQ ID NO: 70667 - RNA, 1701 nt, Artificial Sequence
  derived and/or modified sequence opt1 from hemagglutinin__InfluenzaA__AFQ32573
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgugggggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcgcugcucggguucaucaugugggccugccagaagggcaacauccggugcaacaucugcaucuga

SEQ ID NO: 70668 - RNA, 1701 nt, Artificial Sequence
  derived and/or modified sequence opt1 from hemagglutinin__InfluenzaA__AFQ37281
augaaggccauccuggugguccuccuguacaccuucgccaccacgaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccaccgaccagcagagccuguaccagaacgcggacgccuacguguucgugggcaccucccgguacagcaagaaguucaagcccgagaucgccauccgcccgaagguccgggaccgcgagggccggaugaacuacuacuggacccugguggagcccggggacaagaucacguucgaggccaccggcaaccucguggucccccgcuacgccuucgcgauggagcggaacgccggguccggcaucaucaucagcgacacccccgcccacgacugcaacaccacgugccagaccccgaagggcgccaucaacaccucccugcccuuccagaacgugcaccccaucaccaucgggaagugccccaaguacgucaagagcacgaagcugcgccucgccaccggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacagcaacgugaagaaccucuacgagaagguccggucccagcugaagaacaacgccaaggagaucgggaacggcugcuucgaguucuaccacaagugcgacgacaagugcauggagagcgugaagaacgggaccuacgacuaccccaaguacuccgaggaggccaagcugaaccgcgaggagaucgacggcgugaagcucgagagcacccggaucuaccagauccuggccaucuacuccaccgcggccagcagccugguccucguggugucccugggggccaucagcuucuggaugugcuccaacggcagccugcagugccgcaucugcaucuga

SEQ ID NO: 70669 - RNA, 1707 nt, Artificial Sequence
  derived and/or modified sequence opt1 from hemagglutinin__InfluenzaA__AFQ55689
augaacacccagauccuggcccucaucgccugcaugcugaucggcgcgaagggggacaagaucugccugggccaccacgccguggccaacgggaccaaggucaacacgcucaccgagcgcggcaucgagguggugaacgccaccgagaccgucgagacggccaacaccaagaagaucugcacccaggggaagcggcccaccgaccugggccagugcggccugcucgggacgcugaucggcccgccccagugcgaccaguuccuggaguucgacgcggaccucaucaucgagcgccgggaggggaccgacgugugcuaccccggcaaguucaccaacgaggagagccugcgccagauccugcggggguccggcggcaucgacaaggagagcaugggguucaccuacuccggcauccgcacgaacggggccaccagcgccugccggcgcuccggcagcuccuucuacgccgagaugaaguggcuccugagcaacuccgacaacgcggccuucccccagaugaccaagagcuaccggaacccgcgcaacaagcccgcccugaucaucuggggcgugcaccacuccgggagcgccaccgagcagacgaagcucuacggcuccgggaacaagcugaucaccgucggcagcuccaaguaccagcagagcuucacccccucccccggggcccggccccaggugaacggccagagcggccgcaucgacuuccacuggcugcuccuggacccgaacgacaccgugacguucaccuucaacggggcguucaucgcccccgaccgggccuccuucuuccgcggcgagagcaucgggguccagagcgacgugccccuggacuccggcugcgagggggacugcuuccacaacggcggcaccaucgugagcucccucccguuccagaacaucaacccccggaccgucgggaagugcccccgcuacgugaagcagacgagccugcugcucgccaccggcaugcggaacgugcccgagaacccgaaggaccgcaagucccggcaccgccggacccgcgggcuguucggcgccaucgcgggguucaucgagaacggcugggagggccugaucgacgggugguacggcuuccgccaccagaacgcccagggggagggcaccgccgccgacuacaagagcacgcaguccgccaucgaccagaucaccggcaagcucaaccggcugaucgacaagaccaaccagcaguucgagcugaucgacaacgaguucagcgagaucgagcagcagaucgggaacgucaucaacuggacccgcgacuccaugacggagguguggagcuacaacgcggagcuccugguggccauggagaaccagcacaccaucgaccuggccgacuccgagaugaacaagcucuacgagcggguccgcaagcagcugcgggagaacgccgaggaggacggcaccgggugcuucgagaucuuccacaagugcgacgaccagugcauggagagcauccgcaacaacaccuacgaccacacgcaguaccgggccgagucccugcagaaccgcauccagaucgaccccgugaagcucagcuccggcuacaaggacaucauccugugguucagcuucggggcguccugcuuccugcuccuggccaucgccaugggccugguguucaucugcaucaagaacggcaacaugcggugcaccaucugcaucuga

SEQ ID NO: 70670 - RNA, 1701 nt, Artificial Sequence; identical to SEQ ID NO: 69194
  derived and/or modified sequence opt1 from hemagglutinin__InfluenzaA__AFR68153

SEQ ID NO: 70671 - RNA, 1701 nt, Artificial Sequence
  derived and/or modified sequence opt1 from hemagglutinin__InfluenzaA__AFR68163
augaaggccacccuggugguccuccuguacaccuucgccacggcgaacgccgacacccugugcaucggcuaccacgccaacaacagcaccgacaccguggacacggugcucgagaagaacgucaccgugacccacuccgccaaccugcuggaggacaagcacaacgggaagcucugcaagcugcgcggcguggcgccccugcaccucgggaagugcaacaucgccggcuggauccuggggaacccggagugcgagacccugagcacggccuccagcugguccuacaucgucgagaccagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgugacggccgccugcccgcacgcgggcgccaagggguucuacaagaaccugaucuggcucgucaagaagggcaacagcuaccccaagcuguccaagagcuacaucaacgacaaggggaaggaggugcuggugcucuggggcauccaccaccccuccaccaccgccgaccagcagagccuguaccagaacgccgacaccuacgucuucgugggcacgagccgguacuccaagaaguucaagcccgagaucgccauccgcccgaaggugcgggaccaggaggggcgcaugaacuacuacuggacccuggucgagcccggcgacaagaucaccuucgaggcgaccgggaaccucguggugccccgguacgccuucgccauggagcgcgacgccggcagcggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgugccgagcauccagucccggggccuguucggggccaucgccggcuucaucgagggcggguggacgggcauggucgacgggugguacggcuaccaccaccagaacgagcaggggagcggcuacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccgccgccagcucccuggugcucgucgugagccugggcgccaucuccuucuggaugugcagcaacggcagccugcagugccggaucugcaucuga

SEQ ID NO: 70672 - RNA, 1701 nt, Artificial Sequence
  derived and/or modified sequence opt1 from hemagglutinin__InfluenzaA__AFR68173
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaguccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagaacacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 70673 - RNA, 1701 nt, Artificial Sequence; identical to SEQ ID NO: 63677
  derived and/or modified sequence opt1 from hemagglutinin__InfluenzaA__AFR84675

SEQ ID NO: 70674 - RNA, 1701 nt, Artificial Sequence; identical to SEQ ID NO: 64030
  derived and/or modified sequence opt1 from hemagglutinin__InfluenzaA__AFR84685

SEQ ID NO: 70675 - RNA, 1701 nt, Artificial Sequence; identical to SEQ ID NO: 63857
  derived and/or modified sequence opt1 from hemagglutinin__InfluenzaA__AFR84694

SEQ ID NO: 70676 - RNA, 1701 nt, Artificial Sequence; identical to SEQ ID NO: 63664
  derived and/or modified sequence opt1 from hemagglutinin__InfluenzaA__AFR84704

SEQ ID NO: 70677 - RNA, 1701 nt, Artificial Sequence
  derived and/or modified sequence opt1 from hemagglutinin__InfluenzaA__AFR84714
augaaggccauccuggugguccuccuguacaccuucgccaccgcgaacgccgacacgcugugcaucggcuaccgcgccaacaacagcaccgacaccguggacaccgugcucgagaagaacgucacggugacccacuccgugaacauccuggaggacaagcacaacgggaagcugugcaagcuccggggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccugguggucccccgcuacgccuucgccauggagcggaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcgccuggcgaccggccuccggaacgucccgagcauccagucccgcgggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcuggaguccacccggaucuaccagauccucgcgaucuacagcaccgucgccagcucccuggugcugguggucagccucggggccaucuccuucuggaugugcagcaacggcucccugcagugccgcaucugcaucuga

SEQ ID NO: 70678 - RNA, 1701 nt, Artificial Sequence; identical to SEQ ID NO: 63857
  derived and/or modified sequence opt1 from hemagglutinin__InfluenzaA__AFR84724

SEQ ID NO: 70679 - RNA, 1701 nt, Artificial Sequence; identical to SEQ ID NO: 63857
  derived and/or modified sequence opt1 from hemagglutinin__InfluenzaA__AFR84734

SEQ ID NO: 70680 - RNA, 1701 nt, Artificial Sequence; identical to SEQ ID NO: 63857
  derived and/or modified sequence opt1 from hemagglutinin__InfluenzaA__AFR84754

SEQ ID NO: 70681 - RNA, 1701 nt, Artificial Sequence; identical to SEQ ID NO: 63857
  derived and/or modified sequence opt1 from hemagglutinin__InfluenzaA__AFR84764

SEQ ID NO: 70682 - RNA, 1701 nt, Artificial Sequence; identical to SEQ ID NO: 63857
  derived and/or modified sequence opt1 from hemagglutinin__InfluenzaA__AFR84774

SEQ ID NO: 70683 - RNA, 1701 nt, Artificial Sequence
  derived and/or modified sequence opt1 from hemagglutinin__InfluenzaA__AFR84784
augaaggccauccuggugggccuccuguacaccuucgccaccgcgaacgccgacacgcugugcaucggguaccacgccaacaacagcaccgacaccgucgacaccgugcucgagaagaacgugacggucacccacuccgugaacauccuggaggacaagcacaacggcaagcugugcaagcuccgcgggguggcgccccugcaccugggcaagugcaacaucgccggguggauccucggcaacccggagugcgagagccuguccaccgccagcuccuggagcuacaucgucgagaccuccagcuccgacaacggcacgugcuaccccggggacuucaucgacuacgaggagcugcgggagcagcucagcuccgugagcuccuucgagcgcuucgagaucuuccccaagaccagcuccuggcccaaccacgacagcaacaagggcgugaccgccgccugcccgcacgccggggcgaaguccuucuacaagaaccugaucuggcuggucaagaagggcaacagcuaccccaagcucuccaagagcuacaucaacgacaaggggaaggaggugcuggugcuguggggcauccaccaccccagcaccuccgccgaccagcagagccucuaccagaacgccgacgccuacgucuucgugggcuccagccgguacuccaagaaguucaagcccgagaucgccauccgcccgaaggugcgggaccaggaggggcgcaugaacuacuacuggacgcuggucgagcccggcgacaagaucaccuucgaggcgaccgggaaccugguggugccccgguacgccuucgccauggagcgcaacgccggcagcggcaucaucaucuccgacacccccguccacgacugcaacacgaccugccagaccccgaagggggccaucaacaccagccuccccuuccagaacauccaccccaucacgaucggcaagugccccaaguacgugaaguccaccaagcugcggcuggcgaccgggcuccgcaacgugccgagcauccagucccggggccuguucggggccaucgccggcuucaucgagggcggguggaccggcauggucgacgggugguacggcuaccaccaccagaacgagcaggggagcggcuacgccgccgaccugaaguccacgcagaacgcgaucgacgagaucaccaacaaggugaacagcgugaucgagaagaugaacacccaguucaccgccgucggcaaggaguucaaccaccucgagaagcgcaucgagaaccugaacaagaagguggacgacggguuccuggacaucuggacguacaacgccgagcuccugguccugcucgagaacgagcggacccuggacuaccacgacuccaacgugaagaaccuguacgagaaggugcgcagccagcucaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcuggaguccacccgcaucuaccagauccucgcgaucuacagcaccguggccagcucccuggcccuggucgugagccucggcgccaucuccuucuggaugugcagcaacggcucccugcagugccggaucugcaucuga

SEQ ID NO: 70684 - RNA, 1701 nt, Artificial Sequence; identical to SEQ ID NO: 63857
  derived and/or modified sequence opt1 from hemagglutinin__InfluenzaA__AFR84794

SEQ ID NO: 70685 - RNA, 1701 nt, Artificial Sequence; identical to SEQ ID NO: 63677
  derived and/or modified sequence opt1 from hemagglutinin__InfluenzaA__AFR84804

SEQ ID NO: 70686 - RNA, 1701 nt, Artificial Sequence; identical to SEQ ID NO: 63857
  derived and/or modified sequence opt1 from hemagglutinin__InfluenzaA__AFR84814

SEQ ID NO: 70687 - RNA, 1701 nt, Artificial Sequence; identical to SEQ ID NO: 63677
  derived and/or modified sequence opt1 from hemagglutinin__InfluenzaA__AFR84824

SEQ ID NO: 70688 - RNA, 1701 nt, Artificial Sequence; identical to SEQ ID NO: 63703
  derived and/or modified sequence opt1 from hemagglutinin__InfluenzaA__AFR84834

SEQ ID NO: 70689 - RNA, 1701 nt, Artificial Sequence; identical to SEQ ID NO: 68877
  derived and/or modified sequence opt1 from hemagglutinin__InfluenzaA__AFR84844

SEQ ID NO: 70690 - RNA, 1701 nt, Artificial Sequence; identical to SEQ ID NO: 63919
  derived and/or modified sequence opt1 from hemagglutinin__InfluenzaA__AFR84854

SEQ ID NO: 70691 - RNA, 1701 nt, Artificial Sequence; identical to SEQ ID NO: 63677
  derived and/or modified sequence opt1 from hemagglutinin__InfluenzaA__AFR84864

SEQ ID NO: 70692 - RNA, 1701 nt, Artificial Sequence; identical to SEQ ID NO: 63857
  derived and/or modified sequence opt1 from hemagglutinin__InfluenzaA__AFR84874

SEQ ID NO: 70693 - RNA, 1701 nt, Artificial Sequence; identical to SEQ ID NO: 63664
  derived and/or modified sequence opt1 from hemagglutinin__InfluenzaA__AFR84893

SEQ ID NO: 70694 - RNA, 1701 nt, Artificial Sequence; identical to SEQ ID NO: 63664
  derived and/or modified sequence opt1 from hemagglutinin__InfluenzaA__AFR84903

SEQ ID NO: 70695 - RNA, 1701 nt, Artificial Sequence; identical to SEQ ID NO: 63664
  derived and/or modified sequence opt1 from hemagglutinin__InfluenzaA__AFR84913

SEQ ID NO: 70696 - RNA, 1701 nt, Artificial Sequence; identical to SEQ ID NO: 63664
  derived and/or modified sequence opt1 from hemagglutinin__InfluenzaA__AFR84923

SEQ ID NO: 70697 - RNA, 1689 nt, Artificial Sequence
  derived and/or modified sequence opt1 from hemagglutinin__InfluenzaA__AFV53205
auggccaucaucuaccugauccuccuguucgccaccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagccugaacgacuacgaggagcugaagcaccuccuguccagcgugcggcacuucgagaaggugcgcauccugcccaaggaccgguggacgcagcacaccaccaccggggacuccaaggccugcgccgucagcggcaagcccuccuucuuccgcaacaugguguggcucacgaagaaggggcccgacuacccgguggcgaagggcagcuacaacaacaccuccggggagcagaugcugaucaucuggggcguccaccaccccaucgacgaggccgagcagcgggagcuguaccagaaggugggcaccuacgugagcgccuccaccagcacgcucaacaagcgcuccauccccgagaucgccgcgcggcccgaggucaacgggcugcgcagccggauggaguucuccuggacccugcucgacgugugggacaccaucaacuucgagagcaccggcaaccugaucgccccggaguacggguucaagaucuccaagcgcggcagcagcggcaucaugaagacggaggggacccugggcaacugcgagaccaagugccagacgccccucggggccaucaacaccacccugcccuuccacaacgugcacccccugaccaucggcgagugcccgaaguacgucaaguccgagaagcucgugcuggccaccgggcugcggaacgugccccagaucgagagccgcggccucuucggcgccaucgcgggguucaucgagggcggguggcagggcauggucgacgggugguacggcuaccaccacuccaacgaccagggcagcggguacgccgccgacaaggaguccacgcagaaggccuucgacgagaucaccaacaaggugaacagcgugaucgagaagaugaacacccaguucgaggccgucggcaaggaguucaacaaccuggagaagcggcuggagaaccucaacaagaagauggaggacggguuccuggacguguggaccuacaacgcggagcugcucgugcugauggagaacgagcgcacgcuggacuuccacgacuccaacgucaagaaccucuacgagaaggugcggaugcagcugcgcgacaacgucaaggagcugggcaacgggugcuucgaguucuaccacaagugcgacgacgagugcaucaacagcgugaagaacggcaccuacgacuaccccaaguacgaggaggaguccaagcucaagcggaacgagaucaagggcgugaagcugagcuccaugggggucuaccagauccuggccaucuacgccaccguggccggcagccucucccuggccaucaugauggcggggaucagcuucuggaugugcuccaacggcagccugcagugccgcaucugcaucuga

SEQ ID NO: 70698 - RNA, 1689 nt, Artificial Sequence
  derived and/or modified sequence opt1 from hemagglutinin__InfluenzaA__AFV53216
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacggagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucggcaacugcgagaccaagugccagaccccgcugggggccaucaacacgacccugcccuuccacaacgugcacccccucaccaucggcgagugccccaaguacgucaagagcgagaagcuggugcuggcgaccgggcuccgcaacgugccgcagaucgagucccggggccuguucggggccaucgccggcuucaucgagggcggguggcagggcauggucgacgggugguacggcuaccaccacagcaacgaccagggguccggcuacgccgccgacaaggagagcacgcagaaggcguucgacggcaucaccaacaaggugaacuccgugaucgagaagaugaacacccaguucgaggccgucgagaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgugaagcugagcuccauggggaucuaccagauccucgccaucuacgccaccgucgcgggcagccugucccuggccaucaugauggccgggaucagcuucuggaugugcuccaacggcagccuccagugccgcaucugcaucuga

SEQ ID NO: 70699 - RNA, 1689 nt, Artificial Sequence
  derived and/or modified sequence opt1 from hemagglutinin__InfluenzaA__AFV53227
augaucaucaucuaccugauccuccuguucaccgccgugcgcggcgaccagaucugcaucggguaccacgccaacaacagcaccgagaaggucgacacgauccuggagcggaacgugaccgugacccacgcgaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacaagaccgacggcggguccaaggccugcgccgucagcggcaaggccuccuucuuccggaacaugguguggcugaccaaggaggggcccaacuaccagguggcgaagcgcagcuacaacaacaccuccggcgagcagaugcucaucaucuggggcguccaccaccccaaggacgaggccgagcagaucgcccuguaccagaagguggggacguacgugagcgccuccaccagcacccugaacaagcgguccaccccggagaucgcggcccgccccgaggucaacggccucgggagccggauggaguucuccuggacgcugcuggacgugugggacaccaucaacuucgagagcaccggcaaccucguggcccccgaguacggcuucaagaucuccaagcgcgggagcagcggcaucaugaagaccgaggggacgcugggcaacugcgagaccaagugccagacgccccugggggccaucaacaccacccucccguuccacaacguccacccccugaccaucggcgagugccccaaguacgugaaguccgagaagcuggugcucgccaccggccugcggaacgucccccagaucgagagccgcgggcuguucggcgcgaucgccggguucaucgagggcggguggcagggcaugguggacggcugguacggguaccaccacuccaacgaccagggcagcggguacgccgccgacaaggaguccacccagaaggccuucgaccggaucacgaacaaggugaacagcgucaucgagaagaugaacauccaguucgaggcggugggcaaggaguucuccaaccucgagaagcgccuggagaaccugaacaagaagauggaggacggguuccucgacguguggaccuacaacgccgagcugcugguccucauggagaacgagcggacccuggacuuccacgacagcaacgugaagaaccuguacgacaagguccgcaugcagcuccgggacaacgugaaggagcugggcaacggcugcuucgaguucuaccacaagugcgacgacgagugcaugaacuccgugaagaacgggaccuacgacuacccgaaguacgaggaggagagcaagcugaagcgcaacgagaucaagggcgucaagcucuccagcauggggguguaccagauccuggccaucuacgccacgguggccggcucccugagccucgcgaucaugaucgccggcaucuccuucuggaugugcagcaacgggucccugcagugccgggucugcaucuga

SEQ ID NO: 70700 - RNA, 1689 nt, Artificial Sequence
  derived and/or modified sequence opt1 from hemagglutinin__InfluenzaA__AFV53238
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggaccgguggacgcagcacaccaccaccgggggcuccauggccugcgccgucagcgggaagcccuccuucuuccgcaacaugguguggcugacgaccaagggccccaacuacccgguggcgcaggggagcuacaacaacaccuccggcgagcagaugcucaucaucuggggcguccaccaccccaacgacgaggccgagcagcgggcccuguaccagaagguggggaccuacgugagcgccuccacgagcacccuguacaagcgcuccauccccgagaucgcggcccggcccaaggucaacggccucgggagccgcauggaguucuccuggacccugcuggacaugugggacaccaucaacuucgagagcacgggcaaccucguggccccggaguacggcuucaagaucuccaagcgggggagcagcggcaucaugaagaccgaggggacccuggagaacugcgagaccaagugccagacgccccugggcgccaucaacaccacccuccccuuccacaacgugcacccccugaccaucggggagugcccgaaguacgucaaguccgagaagcuggugcucgccacgggccugcgcaacgugccccagaucgagagccggggccuguucggggcgaucgccggcuucaucgagggcggguggcaggggauggucgacggcugguacggcuaccaccacuccaacgaccaggggagcggcuacgccgccgacaaggaguccacccagaaggccuucgacgggaucaccaacaaggugaacagcgugaucgagaagaugaacacccaguucgaggcggucggcaaggaguucuccaaccucgagaagcgccuggagaaccugaacaagaagauggaggacggguuccucgacguguggacguacaacgccgagcugcuggugcucauggagaacgagcggacccuggacuuccacgacagcaacgucaagaaccuguacgacaaggugcgcaugcagcuccgggacaacgucaaggagcugggcaacggcugcuucgaguucuaccacaagugcgacaacgagugcauggacuccgugaagaacgggaccuacgacuaccccaaguacgaggaggagagcaagcugaaccgcaacgagaucaagggcgugaagcucuccagcaugggggucuaccagauccuggccaucuacgccaccguggccggcucccugagccucgcgaucaugauggccggcaucuccuucuggaugugcagcaacgggucccugcagugccggaucugcaucuga

SEQ ID NO: 70701 - RNA, 1689 nt, Artificial Sequence
  derived and/or modified sequence opt1 from hemagglutinin__InfluenzaA__AFV53249
auggccaucaucuaccugauccuccuguucgccaccgugcgcggcgaccagaucugcaucggguaccacgcgaacaacagcaccgagacggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagccugaacgacuacgaggagcugaagcaccuccuguccagcgugaagcacuucgagaaggugcggauccugcccaaggaccgcuggaccaaccacaccaccaccgggggcuccaaggccugcgccgucagcggggagcccuccuucuuccggaacaugguguggcucacgaagaagggccccaacuacccgguggcgaaggggagcuacaacaacaccuccggcgagcagaugcugaucaucuggggcguccaccaccccaacgacgaggccgagcagcgcgcccuguaccagaagguggggaccuacgugagcgccuccacgagcacccucuacaagcgguccauccccgagaucgcggcccgccccaaggucaacggccuggggagccggauggaguucuccuggacccugcucaacgugugggacaccaucaacuucgagagcacgggcaaccugguggccccggaguacggcuucaagaucuccaagcgcgggcggagcggcaucaugaagaccgaggggacccugggcaacugcgagaccaagugccagacgccccucggggccaucaacaccacccugcccuuccacaacguccacccccugaccaucggcgagugcccgaaguacgucaagagcgagaagcucgugcuggccacgggccugcgcaacgugccccagaucgagucccggggccucuucggggcgaucgccggguucaucgagggcggguggcagggcaugguggacggcugguacggguaccaccacagcaacgaccagggcuccggguacgccgccgacaaggagagcacccagaaggccuucgacggcaucaccaacaaggugaacuccgucaucgagaagaugaacacccaguucgaggcgguggggaaggaguucaacaaccuggagaagcgccuggagaaccucaacaagaagauggaggacggcuuccuggacguguggacguacaacgccgagcugcucguccugauggagaacgagcggacccuggacuuccacgacagcaacgugaagaaccucuacgagaagguccgcaugcagcugcgggacaacgugaaggagcugggcaacgggugcuucgaguucuaccacaagugcgacgacgagugcaugaacuccgugaagaacggcaccuacgacuaccccaaguacgaggaggagagcaagcucaagcgcaacgagaucaagggggucaagcuguccagcaugggcguguaccagauccuggccaucuacgccaccguggccggcucccucagccuggcgaucauggucgccgggaucuccuucuggaugugcagcaacggcucccugcagugccggaucugcaucuga

SEQ ID NO: 70702 - RNA, 1698 nt, Artificial Sequence
  derived and/or modified sequence opt1 from hemagglutinin__InfluenzaA__AFV53260
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaaggcgccccuccagcuggggaacugcaacaucgccggcugggugcuggggaacccggagugcgagagccuccuguccaaccggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaaccacaccacgcgcggggucaccgccgccugcccccacgcgaugaaguccagcuucuacaagaaccugguguggcugaccgaggccaacggcagcuaccccaaccucucccggagcuacgugaacaaccaggagaaggagguccuggugcuguggggcgugcaccaccccuccaacaucgaggaccagcggacccucuaccgcaaggacaacgccuacgucagcguggugagcuccaacuacaaccggcgcuucacgccggagaucgccaagcggcccaagguccgcggccagagcgggcggaucaacuacuacuggacccugcuggagcccggcgacaccaucaucuucgaggccaccggcaaccucaucgcgcccugguacgccuucgcccugucccgcgggccgggcagcgggaucaucacguccaacgcgccccuggacgagugcgacaccaagugccagacgccccagggcgccaucaacagcucccuccccuuccagaacauccacccggugaccaucggcgagugccccaaguacgugcggagcaccaagcugcgcauggucaccgggcugcggaacauccccuccuuccagagccgcggccucuucggggccaucgccggcuucaucgagggcggguggaccggcaugauggacgggugguacggcuaccaccaccagaacgagcagggguccggcuacgccgccgaccagaaguccacccagaacgccaucaacgggaucacgaacaaggugaacagcgugaucgagaagaugaacacccaguucaccgcggucggcaaggaguucaacaagcuggagaagcggauggagaaccugaacaagaagguggacgacggcuuccucgacaucuggaccuacaacgccgagcugcuggugcuccuggagaacgagcgcacgcuggacuuccacgacagcaacgucaagaaccucuacgagaaggugaagaaccagcugcggaacaacgccaaggagcuggggaacggcugcuucgaguucuaccacaagugcgacaacgagugcauggaguccgucaagaacgggaccuacgacuaccccaaguacagcgaggaguccaagcucaaccgcgagaagaucgacggcgugaagcuggagagcauggggguguaccgcauccuggccaucuacuccaccgucgccagcagccucgugcugcuggugucccucggcgcgaucagcuucuggaugugcuccaacggcagccugcagugccggaucugcaucuga

SEQ ID NO: 70703 - RNA, 1689 nt, Artificial Sequence
  derived and/or modified sequence opt1 from hemagglutinin__InfluenzaA__AFV53271
auggccaucaccuaccugauccuccuguucaccgccgugcgcggcgaccagaucugcaucggguaccacgcgaacaacagcacggagaaggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgcuuccugcggguccccgaguggagcuacaucauggagaaggagaacccccgcuacucccugugcuacccgggcagcuucaacgacuacgaggagcucaagcaccuccuguccagcgugaagcacuucgagaaggugaagauccugcccaaggacggguggacccagcacaccaccacgggcggguccauggccugcgccgucagcggcaagcccuccuucuuccggaacaugguguggcugaccgagaaggggcagaacuaccccguggcgaagggcagcuacaacaacaccuccggcgagcagaugcugaucaucuggggcguccaccacccgaacgacgaggccgagcagcgcgcccucuaccagaagguggggaccuacgugagcgccuccacgagcacccugaacaagcgguccacccccgagaucgcggcccgccccaaggucaacgggcugggcagccggauggaguucuccuggacccuccuggacaugugggacacgaucaacuucgagagcaccggcaaccugguggcccccgaguacggguucaagaucuccaagcgcggcagcagcgggaucaugaagaccgagggcacccucgagaacugcgagacgaagugccagaccccgcugggggccaucaacaccacccugcccuuccacaacgugcacccccucacgaucggcgagugccccaaguacgucaaguccgagaagcuggugcuggccaccggccuccggaacaucccgcagaucgagagccgcgggcuguucggcgcgaucgccggguucaucgagggcggguggcagggcaugguggacggcugguacggguaccaccacuccaacgaccagggcagcggguacgccgccgacaaggaguccacccagaaggccuucgacggcaucaccaacaaggucaacagcgugaucgagaagaugaacacgcaguucgaggcgguggggaaggaguucuccaaccuggagaagcggcucgagaaccugaacaagaagauggaggacggcuuccuggacgucuggaccuacaacgccgagcuccuggugcugauggagaacgagcgcacccucgacuuccacgacagcaacgugaagaaccuguacgacaagguccggaugcagcugcgcgacaacgugaaggagcucggcaacgggugcuucgaguucuaccacaagugcgacaacgagugcauggacuccgucaagaacggcaccuacgacuaccccaaguacgaggaggagagcaagcugaaccggaacgagaucaagggggugaagcuguccagcaugggcguguaccagauccucgccaucuacgccacggucgccggcucccugagccuggcgaucaugauggccgggaucuccuucuggaugugcagcaacggcucccuccagugccgcaucugcaucuga

SEQ ID NO: 70704 - RNA, 1689 nt, Artificial Sequence
  derived and/or modified sequence opt1 from hemagglutinin__InfluenzaA__AFV53282
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggaccaacuaccccguggcgaagggcagcuacaacaacaccuccggcgagcagaugcucaucaucuggggcguccaccacccgaacgacgagaccgagcagcggacgcuguaccagaacguggggaccuacgugagcgucgggaccuccacccugaacaagcgcagcacgcccgagaucgccacccggcccaaggugaacggccucggcucccgcauggaguucagcuggacccugcuggacaugugggacaccaucaacuucgaguccacggggaaccucaucgcccccgaguacggcuucaagaucagcaagcggggguccagcggcaucaugaagaccgaggggacccuggagaacugcgagaccaagugccagacgccgcugggcgccaucaacaccacccuccccuuccacaacgugcacccccugaccaucggcgagugccccaaguacgucaagcuggagaagcucgugcuggcgacggggcugcgcaacgugccgcagaucgagagccggggccucuucggggccaucgccggcuucaucgagggcggguggcagggcauggucgacgggugguacggcuaccaccacuccaacgaccaggggagcggcuacgccgccgacaaggaguccacccagaaggcguucgacgugaucaccaacaaggugaacagcgucaucgagaagaugaacacccaguucgaggccguggggaaggaguucuccaaccuggagcgccggcuggagaaccucaacaagaagauggaggacggcuuccuggacguguggacguacaacgccgagcugcucguccugauggagaacgagcgcacccuggacuuccacgacagcaacgugaagaaccucuacgacaagguccggaugcagcugcgcgacaacgugaaggagcugggcaacgggugcuucgaguucuaccacaagugcgacgacgagugcaugaacuccgugaagaacggcaccuacgacuaccccaaguacgaggaggagagcaagcucaaccggaacgagaucaagggggucaagcuguccagcaugggcguguaccagauccuggccaucuacgccaccguggcgggcucccucagccuggccaucaugauggccgggaucuccuucuggaugugcagcaacggcucccugcagugccgcaucugcaucuga

SEQ ID NO: 70705 - RNA, 1689 nt, Artificial Sequence
  derived and/or modified sequence opt1 from hemagglutinin__InfluenzaA__AFV53293
auggccaucaucuaccugauccuccuguucaccagcgugcgcggcgaccagaucugcaucggguaccacgccaacaacuccaccgagaaggucgacacgauccuggagcggaacgugaccgugacccacgcgaagaacauccucgagaagacccacaacggcaagcugugcaagcugaacgggaucccgccccucgagcugggcgacugcagcaucgccggguggcugcucggcaaccccgagugcgaccgccugcugcggguccccgagugguccuacaucauggagaaggagaaccccaaguacagccucugcuacccgggcuccuucaacgacuacgaggagcugaagcaccuccugagcuccgugaagcacuucgagaaggugaagauccugcccaaggacggguggacgcagcacaccaccaacggcgggagccgcgccugcgccgucuccggcaaccccagcuucuuccggaacaugguguggcugaccaagaaggggcccaacuacccgguggccaagggcuccuacaacaacacgagcggcgagcagaugcucaucaucuggggcguccaccaccccaacgacgaggcggagcagcgcgcccuguaccaggagguggggaccuacguguccgccagcaccuccacccugaacaagcggagcacgcccgagaucgccgcgcgccccaaggucaacgggcucggcucccggauggaguucagcuggacccugcuggacaugugggacaccaucaacuucgaguccaccggcaaccucguggccccggaguacggguucaagaucagcaagcgcggcagcuccggggugaugaagacggagggcacccuggagaacugcgagaccaagugccagacgccccugggggccaucaacaccacccuccccuuccacaacguccacccccugaccaucggcgagugcccgaaguacgucaagagcgagaagcuggugcucgccaccggccugcggaacgugccccagaucgagucccgcgggcuguucggcgccaucgcgggguucaucgagggcggguggcagggcaugguggacggcugguacggguaccaccacagcaacgaccagggcuccggguacgccgccgacaaggagagcacgcagaaggccuucgacggcaucaccaacaaggugaacuccgucaucgagaagaugaacacccaguucgaggccguggggaaggaguucagcaaccucgagaagcggcuggagaaccugaacaagaagauggaggacggcuuccucgacguguggaccuacaacgcggagcugcugguccucauggagaacgagcgcacgcuggacuuccacgacuccaacgugaagaaccuguacgacaagguccggaugcagcuccgcgacaacgugaaggagcugggcaacgggugcuucgaguucuaccacaagugcgacgacgagugcauggacagcgugaagaacggcaccuacgacuaccccaaguacgaggaggaguccaagcugaaccggaacgagaucaagggggucaagcucagcuccaugggcguguaccagauccuggccaucuacgccaccguggccggcagccugucccucgccaucaugauggcggggaucagcuucuggaugugcuccaacggcagccugcagugccgcaucugcaucuga

SEQ ID NO: 70706 - RNA, 1689 nt, Artificial Sequence
  derived and/or modified sequence opt1 from hemagglutinin__InfluenzaA__AFV53304
auggccaucaucuaccugauccuccuguucaccgccgugcgcggcgaccagaucugcaucggguaccacgcgaacaacagcaccgagaaggucgacacgauccuggagcagaacgugaccgugacccacgccaaggacauccucgagaagacccacaacggcaagcugugcaagcugaacgggaucccgccccucgagcugggcgacugcuccaucgccggguggcugcucggcaaccccgagugcgaccggcugcugagcguccccgagugguccuacaucauggagaaggagaacccccgcgacggccucugcuacccggggagcuucaacgacuacgaggagcugaagcaccuccuguccagcgugaagcacuucgagaaggugaagauccugcccaaggaccgguggacgcagcacaccaccaccggcgggucccgcgccugcgccgucagcggcaaccccuccuucuuccggaacaugguguggcugacgaagaaggagagcaacuaccccguggcgaagggguccuacaacaacaccagcggcgagcagaugcucaucaucuggggcguccaccacccgaacgacgagaccgagcagcgcacccuguaccagaacguggggacguacguguccgucggcaccagcacccugaacaagcgguccacccccaacaucgccacgcgccccaaggugaacgggcucggcagccggauggaguucuccuggacccugcuggacaugugggacaccaucaacuucgagagcaccggcaaccucaucgcccccgaguacggguucaagaucuccaagcgcggcagcagcgggaucaugaagacggagggcacccuggagaacugcgagaccaagugccagaccccgcugggggccaucaacacgacccuccccuuccacaacgugcacccccugaccaucggcgagugccccaaguacgucaaguccgagaagcuggugcucgcgaccggccugcggaacgugccgcagaucgagagccgcgggcuguucggcgccaucgccggguucaucgagggcggguggcagggcauggucgacggcugguacggguaccaccacuccaacgaccagggcagcggguacgccgccgacaaggaguccacgcagaaggcguucgacggcaucaccaacaaggugaacagcgugaucgagaagaugaacacccaguucgaggccgucgggaaggaguucuccaaccucgagcggcgccuggagaaccugaacaagaagauggaggacggcuuccucgacguguggaccuacaacgccgagcugcuggugcucauggagaacgagcggacgcuggacuuccacgacagcaacgucaagaaccuguacgacaaggugcgcaugcagcuccgggacaacgucaaggagcugggcaacgggugcuucgaguucuaccacaagugcgacgacgagugcaugaacuccgugaagaacggcaccuacgacuaccccaaguacgaggaggagagcaagcugaaccgcaacgagaucaagggggugaagcucuccagcaugggcgucuaccagauccuggccaucuacgccaccguggcgggcucccugagccucgccaucaugauggccgggaucuccuucuggaugugcagcaacggcucccugcagugccggaucugcaucuga

SEQ ID NO: 70707 - RNA, 1689 nt, Artificial Sequence
  derived and/or modified sequence opt1 from hemagglutinin__InfluenzaA__AFV53314
auggccaucaucuaccugauccuccuguucaccgccgugcgcggcgacaagaucugcaucggguaccacgcgaacaacagcaccgagacggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccggaacggccucugcuacccggggaacuucaacgacuacgaggagcugaagcaccuccugagcuccgugaagcacuucgagaaggugaagauccugcccaaggaccgcuggacccagcacaccaccacgggcgggagccaggccugcgccgucuccggcaaccccagcuucuuccggaacaugguguggcugaccgagaaggaguccaacuaccccguggcgaaggggagcuacaacaacaccuccggcgagcagaugcucaucaucuggggcguccaccacccgaucgacgagaccgagcagcgcacgcuguaccagaacguggggaccuacgugagcgucggcaccuccacccugaacaagcggagcacgcccgagaucgccaagcgccccaaggugaacgggcucggcucccggauggaguucagcuggacccugcuggacaugugggacaccaucaccuucgaguccacgggcaaccucaucgcccccgaguacggguucaagaucagcaagcgcggcuccagcgggaucaugaagaccgagggcacccuggagaacugcgagaccaagugccagacgccgcugggggccaucaacaccacccuccccuuccacaacgugcacccccugaccaucggcgagugccccaaguacgucaagagcgagaagcuggugcucgcgacgggccugcggaacgugccgcagaucgagucccgcgggcuguucggcgccaucgccggguucaucgagggcggguggcagggcauggucgacggcugguacggguaccaccacagcaacgaccagggcuccggguacgccgccgacaaggagagcacccagaaggcguucgacggcaucaccaacaaggugaacgccgugaucgagaagaucaacacccaguucgaggccgucgggaaggaguucuccaaccucgagcggcgccuggagaaccugaacaagaagauggaggacggcuuccucgacguguggacguacaacgccgagcugcuggugcucauggagaacgagcggacccuggacuuccacgacagcaacgucaagaaccuguacgacaaggugcgcaugcagcuccgggacaacgucaaggagcugggcaacgggugcuucgaguucuaccacaagugcgacgacgagugcaugaacuccgugaagaacggcaccuacgacuaccccaaguacgaggaggagagcaagcugaaccgcaacgagaucaagggggugaagcucuccagcaugggcgucuaccagauccuggccaucuacgcgaccguggccggcucccugagccucgccaucaugauggccgggaucuccuucuggaugugcagcaacggcucccugcagugccggaucugcaucuga

SEQ ID NO: 70708 - RNA, 1689 nt, Artificial Sequence
  derived and/or modified sequence opt1 from hemagglutinin__InfluenzaA__AFV53325
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuacaccguggcgaagggcuccuacaacaacaccagcggcgagcagaugcucaucaucuggggcguccaccaccccaacgacgagaccgagcagcggacgcuguaccagaacguggggaccuacguguccgucagcaccuccacccugaacaagcgcagcacgccggagaucgccacccggcccaaggugaacgggcucggcucccgcauggaguucagcuggacccugcuggacaugugggacaccaucaacuucgaguccacgggcaaccucaucgcccccgaguacggguucaagaucagcaagcggggcagcuccgggaucaugaagaccgagggcacccuggagaacugcgagaccaagugccagacgccccugggggccaucaacaccacccucccguuccacaacgugcacccccugaccaucggcgagugccccaaguacgucaagagcgagaagcuggugcucgcgacgggccugcgcaacgugccccagaucgagucccgggggcuguucggcgccaucgccggguucaucgagggcggguggcagggcauggucgacggcugguacggguaccaccacagcaacgaccagggcuccggguacgccgccgacaaggagagcacccagaaggcguucgacggcaucaccaacaaggugaacuccgugaucgagaagaugaacacccaguucgaggccgucgggaaggaguucagcaaccucgagcgccggcuggagaaccugaacaagaagauggaggacggcuuccucgacguguggacguacaacgccgagcugcuggugcucauggagaacgagcgcacccuggacuuccacgacuccaacgucaagaaccuguacgacaaggugcggaugcagcuccgcgacaacgucaaggagcugggcaacgggugcuucgaguucuaccacaagugcgacgacgagugcaugaacagcgugaagaacggcaccuacgacuacccgaaguacgaggaggaguccaagcugaaccggaacgagaucaagggggugaagcucagcuccaugggcgucuaccagauccuggccaucuacgccaccguggcgggcagccugucccucgccaucaugauggccgggaucagcuucuggaugugcuccaacggcagccugcagugccgcaucugcaucuga

SEQ ID NO: 70709 - RNA, 1689 nt, Artificial Sequence
  derived and/or modified sequence opt1 from hemagglutinin__InfluenzaA__AFV53336
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccucuccagcgugaagcaccuggagaaggugaagauccugcccaaggacggguggacgcagcacgagaccgacggcggguccaaggccugcgccgucagcggcaagcccuccuucuuccggaacaugguguggcucaccaagaaggggcccaacuacccgguggcgaagcgcagcuacaacaacaccuccggcgagcagaugcugaucaucuggggcguccaccaccccaacgacgaggccgagcagcgggcccuguaccagaagguggggacguacgugagcgccuccaccagcacccucaacaagcgcuccacccccgagaucgcggcccggcccgaggucagcggccuggggucccgcauggaguucagcuggacgcugcucgacgugugggacaccaucuccuucgagagcaccggcaaccugguggccccggaguacggcuucaagaucagcaagcggggguccagcggcaucaugaagaccgaggggacgcugggcaacugcgagaccaagugccagacgccccucggggccaucaacaccacccugcccuuccacaacguccacccccugaccaucggcgagugcccgaaguacgugaaguccgagaagcucgugcuggccaccggccugcgcaacgucccccagaucgagagccgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacagcgucaucgagaagaugaacacccaguucgaggcggugggcaaggaguucuccaaccuggagaagcggcuggagaaccucaacaagaagauggaggacggguuccuggacguguggaccuacaacgccgagcugcucguccugauggagaacgagcgcauccuggacuuccacgacagcaacgugaagaaccucuacgacaagguccggaugcagcugcgcgacaacgugaaggagcugggcaacggcugcuucgaguucuaccacaagugcgacgacgagugcaugaacuccgugaagaacgggaccuacgacuaccccaaguacgaggaggagagcaagcucaagcggaacgagaucaagggcgucaagcuguccagcauggggguguaccagauccuggccaucuacgccacgguggccggcucccucagccuggcgaucaugaucgccggcaucuccuucuggaugugcagcaacgggucccugcagugccgcaucugcaucuga

SEQ ID NO: 70710 - RNA, 1701 nt, Artificial Sequence
  derived and/or modified sequence opt1 from hemagglutinin__InfluenzaA__AFV68720
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccgacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcauccggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 70711 - RNA, 1701 nt, Artificial Sequence; identical to SEQ ID NO: 63677
  derived and/or modified sequence opt1 from hemagglutinin__InfluenzaA__AFX96347

SEQ ID NO: 70712 - RNA, 1701 nt, Artificial Sequence
  derived and/or modified sequence opt1 from hemagglutinin__InfluenzaA__AFX96359
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucaacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 70713 - RNA, 1701 nt, Artificial Sequence
  derived and/or modified sequence opt1 from hemagglutinin__InfluenzaA__AFX96366
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgaccggggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccagcuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70714 - RNA, 1701 nt, Artificial Sequence; identical to SEQ ID NO: 65177
  derived and/or modified sequence opt1 from hemagglutinin__InfluenzaA__AFX96383

SEQ ID NO: 70715 - RNA, 1701 nt, Artificial Sequence; identical to SEQ ID NO: 63677
  derived and/or modified sequence opt1 from hemagglutinin__InfluenzaA__AFX96398

SEQ ID NO: 70716 - RNA, 1701 nt, Artificial Sequence; identical to SEQ ID NO: 63677
  derived and/or modified sequence opt1 from hemagglutinin__InfluenzaA__AFX96408

SEQ ID NO: 70717 - RNA, 1701 nt, Artificial Sequence; identical to SEQ ID NO: 63677
  derived and/or modified sequence opt1 from hemagglutinin__InfluenzaA__AFX96418

SEQ ID NO: 70718 - RNA, 1701 nt, Artificial Sequence; identical to SEQ ID NO: 63677
  derived and/or modified sequence opt1 from hemagglutinin__InfluenzaA__AFX96428

SEQ ID NO: 70719 - RNA, 1701 nt, Artificial Sequence; identical to SEQ ID NO: 63677
  derived and/or modified sequence opt1 from hemagglutinin__InfluenzaA__AFX96438

SEQ ID NO: 70720 - RNA, 1701 nt, Artificial Sequence; identical to SEQ ID NO: 63677
  derived and/or modified sequence opt1 from hemagglutinin__InfluenzaA__AFX96448

SEQ ID NO: 70721 - RNA, 1701 nt, Artificial Sequence; identical to SEQ ID NO: 63677
  derived and/or modified sequence opt1 from hemagglutinin__InfluenzaA__AFX96458

SEQ ID NO: 70722 - RNA, 1701 nt, Artificial Sequence; identical to SEQ ID NO: 63677
  derived and/or modified sequence opt1 from hemagglutinin__InfluenzaA__AFX96468

SEQ ID NO: 70723 - RNA, 1701 nt, Artificial Sequence; identical to SEQ ID NO: 63677
  derived and/or modified sequence opt1 from hemagglutinin__InfluenzaA__AFX96478

SEQ ID NO: 70724 - RNA, 1701 nt, Artificial Sequence; identical to SEQ ID NO: 63677
  derived and/or modified sequence opt1 from hemagglutinin__InfluenzaA__AFX96488

SEQ ID NO: 70725 - RNA, 1701 nt, Artificial Sequence
  derived and/or modified sequence opt1 from hemagglutinin__InfluenzaA__AFX96498
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 70726 - RNA, 1701 nt, Artificial Sequence; identical to SEQ ID NO: 63677
  derived and/or modified sequence opt1 from hemagglutinin__InfluenzaA__AFX96508

SEQ ID NO: 70727 - RNA, 1701 nt, Artificial Sequence; identical to SEQ ID NO: 65177
  derived and/or modified sequence opt1 from hemagglutinin__InfluenzaA__AFX96518

SEQ ID NO: 70728 - RNA, 1701 nt, Artificial Sequence; identical to SEQ ID NO: 63677
  derived and/or modified sequence opt1 from hemagglutinin__InfluenzaA__AFX96528

SEQ ID NO: 70729 - RNA, 1701 nt, Artificial Sequence; identical to SEQ ID NO: 65177
  derived and/or modified sequence opt1 from hemagglutinin__InfluenzaA__AFX96538

SEQ ID NO: 70730 - RNA, 1701 nt, Artificial Sequence
  derived and/or modified sequence opt1 from hemagglutinin__InfluenzaA__AFX96548
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 70731 - RNA, 1701 nt, Artificial Sequence; identical to SEQ ID NO: 63677
  derived and/or modified sequence opt1 from hemagglutinin__InfluenzaA__AFX96558

SEQ ID NO: 70732 - RNA, 1701 nt, Artificial Sequence; identical to SEQ ID NO: 64837
  derived and/or modified sequence opt1 from hemagglutinin__InfluenzaA__AFX96568

SEQ ID NO: 70733 - RNA, 1701 nt, Artificial Sequence; identical to SEQ ID NO: 64837
  derived and/or modified sequence opt1 from hemagglutinin__InfluenzaA__AFX96578

SEQ ID NO: 70734 - RNA, 1701 nt, Artificial Sequence; identical to SEQ ID NO: 63677
  derived and/or modified sequence opt1 from hemagglutinin__InfluenzaA__AFX96588

SEQ ID NO: 70735 - RNA, 1701 nt, Artificial Sequence; identical to SEQ ID NO: 63677
  derived and/or modified sequence opt1 from hemagglutinin__InfluenzaA__AFX96598

SEQ ID NO: 70736 - RNA, 1701 nt, Artificial Sequence
  derived and/or modified sequence opt1 from hemagglutinin__InfluenzaA__AFX96608
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccacccuggccagcagccucguccugguggugucccugggggccaucagcuucuggaugugcuccaacggcagccuccagugccggaucugcaucuga

SEQ ID NO: 70737 - RNA, 1701 nt, Artificial Sequence; identical to SEQ ID NO: 63677
  derived and/or modified sequence opt1 from hemagglutinin__InfluenzaA__AFX96618

SEQ ID NO: 70738 - RNA, 1701 nt, Artificial Sequence; identical to SEQ ID NO: 64837
  derived and/or modified sequence opt1 from hemagglutinin__InfluenzaA__AFX96628

SEQ ID NO: 70739 - RNA, 1701 nt, Artificial Sequence
  derived and/or modified sequence opt1 from hemagglutinin__InfluenzaA__AFX96638
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugguguggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucauggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70740 - RNA, 1701 nt, Artificial Sequence; identical to SEQ ID NO: 63677
  derived and/or modified sequence opt1 from hemagglutinin__InfluenzaA__AFX96648

SEQ ID NO: 70741 - RNA, 1701 nt, Artificial Sequence; identical to SEQ ID NO: 64837
  derived and/or modified sequence opt1 from hemagglutinin__InfluenzaA__AFX96658

SEQ ID NO: 70742 - RNA, 1701 nt, Artificial Sequence
  derived and/or modified sequence opt1 from hemagglutinin__InfluenzaA__AFX96668
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugcagcaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 70743 - RNA, 1701 nt, Artificial Sequence
  derived and/or modified sequence opt1 from hemagglutinin__InfluenzaA__AFX96678
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgccccaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 70744 - RNA, 1701 nt, Artificial Sequence
  derived and/or modified sequence opt1 from hemagglutinin__InfluenzaA__AFX96688
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggacugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgacggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 70745 - RNA, 1701 nt, Artificial Sequence; identical to SEQ ID NO: 63677
  derived and/or modified sequence opt1 from hemagglutinin__InfluenzaA__AFX96698

SEQ ID NO: 70746 - RNA, 1701 nt, Artificial Sequence
  derived and/or modified sequence opt1 from hemagglutinin__InfluenzaA__AFX96718
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagaucuccaagagcuacaucaacgacaagggcaaggaggugcugguccugugggggauccaccaccccagcaccuccgccgaccagcagagccucuaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccugguggucccccgguacgcguucgccauggagcgcaacgccggguccggcaucaucaucagcgacacccccgugcacgacugcaacacgaccugccagaccccgaagggcgccaucaacaccucccuccccuuccagaacauccaccccaucaccaucgggaagugccccaaguacgucaagagcaccaagcugcggcuggccacgggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaaggccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgccaucuacuccaccguggcgagcagccugguccugguggugucccucggggccaucagcuucuggaugugcuccaacggcagccugcagugccggaucugcaucuga

SEQ ID NO: 70747 - RNA, 1701 nt, Artificial Sequence; identical to SEQ ID NO: 70746
  derived and/or modified sequence opt1 from hemagglutinin__InfluenzaA__AFX96728

SEQ ID NO: 70748 - RNA, 1701 nt, Artificial Sequence; identical to SEQ ID NO: 64147
  derived and/or modified sequence opt1 from hemagglutinin__InfluenzaA__AFX96738

SEQ ID NO: 70749 - RNA, 1701 nt, Artificial Sequence
  derived and/or modified sequence opt1 from hemagglutinin__InfluenzaA__AFX96748
augaaggccauccuggugguccuccuguacaccaucgccaccgcgaacgccgacacgcugugcaucggcuaccacgccaacaacagcaccgacaccguggacaccgugaucgagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 70750 - RNA, 1701 nt, Artificial Sequence
  derived and/or modified sequence opt1 from hemagglutinin__InfluenzaA__AFX96758
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacacguacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 70751 - RNA, 1701 nt, Artificial Sequence
  derived and/or modified sequence opt1 from hemagglutinin__InfluenzaA__AFX96768
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgaucagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccaccaagaucuaccagauccuggcgaucuacagcaccgucgccuccagccuggugcucguggucagccugggggccaucuccuucuggaugugcagcaacggcucccugcagugccgcaucugcaucuga

SEQ ID NO: 70752 - RNA, 1701 nt, Artificial Sequence
  derived and/or modified sequence opt1 from hemagglutinin__InfluenzaA__AFX96778
augaaggccauccuggugauccuccuguacaccuucgccaccgcgaacgccgacacgcugugcaucggcuaccacgccaacaacagcaccgacaccgucgacaccauccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccuccgccgaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70753 - RNA, 1701 nt, Artificial Sequence
  derived and/or modified sequence opt1 from hemagglutinin__InfluenzaA__AFX96788
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70754 - RNA, 1701 nt, Artificial Sequence; identical to SEQ ID NO: 70753
  derived and/or modified sequence opt1 from hemagglutinin__InfluenzaA__AFX96798

SEQ ID NO: 70755 - RNA, 1701 nt, Artificial Sequence; identical to SEQ ID NO: 64837
  derived and/or modified sequence opt1 from hemagglutinin__InfluenzaA__AFX96808

SEQ ID NO: 70756 - RNA, 1701 nt, Artificial Sequence; identical to SEQ ID NO: 67917
  derived and/or modified sequence opt1 from hemagglutinin__InfluenzaA__AFX96818

SEQ ID NO: 70757 - RNA, 1701 nt, Artificial Sequence; identical to SEQ ID NO: 70753
  derived and/or modified sequence opt1 from hemagglutinin__InfluenzaA__AFX96828

SEQ ID NO: 70758 - RNA, 1701 nt, Artificial Sequence; identical to SEQ ID NO: 66274
  derived and/or modified sequence opt1 from hemagglutinin__InfluenzaA__AFX96838

SEQ ID NO: 70759 - RNA, 1701 nt, Artificial Sequence
  derived and/or modified sequence opt1 from hemagglutinin__InfluenzaA__AFX96856
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcacccacgccggcgcgaaguccuucuacaagaaccugaucuggcucgugaagaaggggaacagcuacccgaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucgccauggagcgcaacgccggguccggcaucaucaucagcgacacccccgugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70760 - RNA, 1701 nt, Artificial Sequence; identical to SEQ ID NO: 70742
  derived and/or modified sequence opt1 from hemagglutinin__InfluenzaA__AFX96904

SEQ ID NO: 70761 - RNA, 1701 nt, Artificial Sequence; identical to SEQ ID NO: 65177
  derived and/or modified sequence opt1 from hemagglutinin__InfluenzaA__AFX96914

SEQ ID NO: 70762 - RNA, 1701 nt, Artificial Sequence
  derived and/or modified sequence opt1 from hemagglutinin__InfluenzaA__AFX96924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagcgcuucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 70763 - RNA, 1701 nt, Artificial Sequence; identical to SEQ ID NO: 63677
  derived and/or modified sequence opt1 from hemagglutinin__InfluenzaA__AFX96934

SEQ ID NO: 70764 - RNA, 1701 nt, Artificial Sequence
  derived and/or modified sequence opt1 from hemagglutinin__InfluenzaA__AFY24097
augaaggccauccuggugguccuccuguacaccuucgccaccgcgaacgccgacacgcugugcaucggcuaccacgccgacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccagcacggaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 70765 - RNA, 1701 nt, Artificial Sequence; identical to SEQ ID NO: 61638
  derived and/or modified sequence opt1 from hemagglutinin__InfluenzaA__AFY24162

SEQ ID NO: 70766 - RNA, 1701 nt, Artificial Sequence
  derived and/or modified sequence opt1 from hemagglutinin__InfluenzaA__AFY24195
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcauccggaacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 70767 - RNA, 1701 nt, Artificial Sequence; identical to SEQ ID NO: 61193
  derived and/or modified sequence opt1 from hemagglutinin__InfluenzaA__AFY24217

SEQ ID NO: 70768 - RNA, 1701 nt, Artificial Sequence
  derived and/or modified sequence opt1 from hemagglutinin__InfluenzaA__AGB08294
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcugaucaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgugauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgucaaguccaccaagcuccgccuggccaccggccugcggaacaucccgagcauccagucccgcggccucuucggggcgaucgccggguucaucgagggcggcuggacggggaugguggacggcugguacggguaccaccaccagaacgcccagggcagcggguacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuacccccgcuacagcgaggaggccaagcucaaccgggaggagaucgacggcgugaagcuggaguccacccgcaucuaccagauccuggcgaucuacagcaccgucgccuccagccucgugcugguggucagccugggggccaucuccuucuggaugugcagcaacggcucccuccagugccggaucugcaucuga

SEQ ID NO: 70769 - RNA, 1701 nt, Artificial Sequence
  derived and/or modified sequence opt1 from hemagglutinin__InfluenzaA__AGB08295
augaaggccauccuggugguccuccuguacaccuucgccaccgcgaacgccgacacgcugugcaucggcuaccacgccaacaacagcaccgacaccguggacaccgugaucgagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucaacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagcggaaggaggugcugguccuguggggcauccaccaccccagcaccacggccgaccagcagucccucuaccagaacgccgacgccuacguguucguggggaccagccgcuacuccaagaaguucaagcccgagaucgccauccggccgaagguccgcgaccaggagggccggaugaacuacuacuggacccugguggagcccggcgacaagaucaccuucgaggcgacggggaaccugguggucccccgcuacgccuucgccauggagcggaccgccggcagcgggaucaucaucuccgacacccccgugcacgacugcaacaccacgugccagaccccgaagggcgccaucaacaccagccuccccuuccagaacauccaccccaucaccaucggcaagugccccaaguacgugaaguccacgaagcugcgccuggcgaccgggcuccggaacaucccgagcauccagucccgcggccuguucggggccaucgccggcuucaucgagggcggguggaccggcauggucgacgggugguacggcuaccaccaccagaacgagcaggggagcggcuacgccgccgaccugaaguccacccagaacgcgaucgacaagaucacgaacaaggugaacagcgugaucgagaagaugaacacccaguucaccgccgucgggaaggaguucaaccaccucgagaagcggaucgagaaccugaacaagaagguggacgacggcuuccuggacaucuggaccuacaacgccgagcuccugguccugcucgagaacgagcgcacgcuggacuaccacgacuccaacgugaagaaccuguacgagaaggugcggaaccagcucaagaacaacgccaaggagaucggcaacgggugcuucgaguucuaccacaagugcgacaacacgugcauggagagcgucaagaacggcaccuacgacuaccccaaguacuccgaggaggccaagcugaaccgcgaggagaucgacggggugaagcuggagagcacccggaucuaccagauccucgcgaucuacuccaccguggccagcucccugguccugguggugagccucggcgccaucagcuucuggaugugcuccaacgggagccugcagugccgcaucugcaucuga

SEQ ID NO: 70770 - RNA, 1701 nt, Artificial Sequence
  derived and/or modified sequence opt1 from hemagglutinin__InfluenzaA__AGB08296
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccggggccaggaggggcgcaugaacuacuacuggacccugguggagcccggcgacaagaucaccuucgaggcgacggggaaccucguggucccccgguacgccuucgccauggagcgcaccgccggcagcggcaucaucaucuccgacacccccgugcacgacugcaacaccacgugccagaccccgaagggggccaucaacaccagccugcccuuccagaacauccaccccaucaccaucggcaagugccccaaguacgugaaguccacgaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacccagaacgcgaucgacaagaucacgaacaaggugaacagcgucaucgagaagaugaacacccaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcucccuggugcucguggucagccugggcgccaucagcuucuggaugugcuccaacggcagccugcagugccggaucugcaucuga

SEQ ID NO: 70771 - RNA, 1701 nt, Artificial Sequence
  derived and/or modified sequence opt1 from hemagglutinin__InfluenzaA__AGB08297
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccgagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaccgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 70772 - RNA, 1701 nt, Artificial Sequence
  derived and/or modified sequence opt1 from hemagglutinin__InfluenzaA__AGB08298
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuacccccggcuguccaagagcuacaucaacgacaagggcaaggaggugcuggugcucugggggauccaccaccccagcaccacggccgaccagcagucccuguaccagaacgccgacgccuacgucuucgugggcaccagccgcuacuccaagaaguucaagcccgagaucgccauccggccgaaggugcgcgaccaggagggccggaugaacuacuacuggacccuggucgagcccggggacaagaucaccuucgaggcgacgggcaaccucguggugccccgcuacgccuucgccauggagcggaccgccgggagcggcaucaucaucuccgacacccccguccacgacugcaacaccacgugccagaccccgaagggcgccaucaacaccagccugcccuuccagaacauccaccccaucaccaucgggaagugccccaaguacgugaaguccacgaagcugcgccucgcgaccggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucacgaacaaggugaacagcgugaucgagaagaugaacacccaguucaccgccgucggcaaggaguucaaccagcuggagaagcggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 70773 - RNA, 1701 nt, Artificial Sequence
  derived and/or modified sequence opt1 from hemagglutinin__InfluenzaA__AGB08301
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccguggucaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacaacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 70774 - RNA, 1701 nt, Artificial Sequence
  derived and/or modified sequence opt1 from hemagglutinin__InfluenzaA__AGB08343
augaagaccaucaucgcccugagcuacaucuucugccucgugcuggcccaggaccugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacaacccccaccggauccuggacggcaucaacugcacccugaucgacgcccuccugggggacccccacugcgacggcuuccagaacaagaagugggaccuguucguggagcgcuccaaggccuucagcaacugcuaccccuacgacgugccggacuacgcgucccuccggagccuggucgccuccagcggcacgcuggaguucaucaacgagggguucaacuggaccggcgugacccagaacgggggcuccuacgccugcaagcgcgggcccgacaacggcuucuucagccggcucaacuggcuguacaaguccgagagcaccuaccccgugcugaacgucacgaugcccaacaacgacaacuucgacaagcucuacaucuggggcgugcaccacccguccaccgacaaggagcagaccaaccuguacgugcaggccagcgggcgcgucaccguguccacgaagcggagccagcagaccaucauccccaacgugggcucccgccccuggguccgggggcugagcagccgcaucuccaucuacuggaccaucgugaagcccggcgacauccucgugaucaacagcaacggcaaccugaucgcgccgcggggguacuucaagauccgcaacggcaaguccagcaucaugcgguccgacgcccccaucgggaccugcagcuccgagugcaucacgcccaacggcagcauccccaacgacaagccguuccagaacgucaacaagaucaccuacggggccugccccaaguacgugaagcagaacacccugaagcucgccaccggcaugcgcaacgugcccgagaagcagacgcggggcaucuucggggccaucgcgggcuucaucgagaacgggugggagggcaugaucgacgggugguacggcuuccgccaccagaacuccgagggcaccgggcaggccgccgaccucaagagcacccaggccgccaucgaccagaucaacggcaagcugaaccgggucaucgagaagaccaacgagaaguuccaccagaucgagaaggaguucuccgagguggaggggcgcauccaggaccucgagaaguacguggaggacacgaagaucgaccuguggagcuacaacgcggagcugcucgucgcccuggagaaccagcacaccaucgaccugaccgacuccgagaugaacaagcuguucgagaagacccggcgccagcugcgggagaacgccgaggacaugggcaacgggugcuucaagaucuaccacaagugcgacaacgccugcaucggcagcauccgcaacggcacguacgaccacgacguguaccgcgacgaggcccugaacaaccgguuccagaucaagggggucgagcucaaguccggcuacaaggacuggauccuguggaucagcuucgcgaucuccugcuuccugcucugcguggugcugcugggguucaucaugugggccugccagaagggcaacauccgcugcaacaucugcaucuga

SEQ ID NO: 70775 - RNA, 1701 nt, Artificial Sequence
  derived and/or modified sequence opt1 from hemagglutinin__InfluenzaA__AGB08362
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgacaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 70776 - RNA, 1701 nt, Artificial Sequence; identical to SEQ ID NO: 67830
  derived and/or modified sequence opt1 from hemagglutinin__InfluenzaA__AGB12986

SEQ ID NO: 70777 - RNA, 1701 nt, Artificial Sequence; identical to SEQ ID NO: 68094
  derived and/or modified sequence opt1 from hemagglutinin__InfluenzaA__AGB13006

SEQ ID NO: 70778 - RNA, 1701 nt, Artificial Sequence
  derived and/or modified sequence opt1 from hemagglutinin__InfluenzaA__AGB13016
augaaggccauccuggugguccuccuguacaccaucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgaucggcaaccucguggucccccgguacgccuucgccauggagaagaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcgcgcgggucuaccagauccuggccaucuacuccaccguggccagcucccuggugcucgucgugagccugggggccaucagcuucuggaugugcuccaacggcagccugcagugccgcaucugcaucuga

SEQ ID NO: 70779 - RNA, 1701 nt, Artificial Sequence; identical to SEQ ID NO: 67875
  derived and/or modified sequence opt1 from hemagglutinin__InfluenzaA__AGB13026

SEQ ID NO: 70780 - RNA, 1701 nt, Artificial Sequence; identical to SEQ ID NO: 67817
  derived and/or modified sequence opt1 from hemagglutinin__InfluenzaA__AGB13036

SEQ ID NO: 70781 - RNA, 1701 nt, Artificial Sequence
  derived and/or modified sequence opt1 from hemagglutinin__InfluenzaA__AGB13048
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcaucgagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 70782 - RNA, 1701 nt, Artificial Sequence
  derived and/or modified sequence opt1 from hemagglutinin__InfluenzaA__AGB13066
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgugaagggcaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagcacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucagccugggcgccaucuccuucuggaugugcagcaacggcucccugcagugccggaucugcaucuga

SEQ ID NO: 70783 - RNA, 1701 nt, Artificial Sequence; identical to SEQ ID NO: 67917
  derived and/or modified sequence opt1 from hemagglutinin__InfluenzaA__AGB13082

SEQ ID NO: 70784 - RNA, 1701 nt, Artificial Sequence; identical to SEQ ID NO: 67817
  derived and/or modified sequence opt1 from hemagglutinin__InfluenzaA__AGB13105

SEQ ID NO: 70785 - RNA, 1701 nt, Artificial Sequence; identical to SEQ ID NO: 67875
  derived and/or modified sequence opt1 from hemagglutinin__InfluenzaA__AGB13125

SEQ ID NO: 70786 - RNA, 1701 nt, Artificial Sequence; identical to SEQ ID NO: 67875
  derived and/or modified sequence opt1 from hemagglutinin__InfluenzaA__AGB13130

SEQ ID NO: 70787 - RNA, 1701 nt, Artificial Sequence
  derived and/or modified sequence opt1 from hemagglutinin__InfluenzaA__AGB13140
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagccucugguccuacaucguggagaccagcuccagcgacaacggcacgugcuaccccggcgacuucaucgacuacgaggagcugcgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccucaucuggcuggugaagaaggggaacuccuaccccaagcugagcaaguccuacaucaacgacaagggcaaggaggugcucguccugugggggauccaccaccccagcaccacggccgaccagcagagccuguaccagaacgccgacaccuacguguucgugggcaccucccgguacagcaagaaguucaagcccgagaucgccauccgcccgaagguccgggaccaggagggccgcaugaacuacuacuggacccucguggagcccggggacaagaucacguucgaggccaccggcaaccugguggucccccgguacgcguucgccauggagcgcaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcuccggcuggccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacagcaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggccaucuacagcaccgucgcguccagccucgugcugguggucucccugggggccaucagcuucuggaugugcagcaacggcucccuccagugccggaucugcaucuga

SEQ ID NO: 70788 - RNA, 1701 nt, Artificial Sequence
  derived and/or modified sequence opt1 from hemagglutinin__InfluenzaA__AGB13159
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgccagccugcaccuggggaagugcaacaucgccggcuggauccucgggaaccccgagugcgagucccugagcaccgcguccagcugguccuacaucguggagaccagcuccagcgacaacggcacgugcuacccgggcgacuucaucgacuacgaggagcugcgggagcagcucuccagcguguccagcuucgagcgcuucgagaucuuccccaagaccuccagcuggcccaaccacgacuccaacaagggggucaccgccgccugcccccacgccggcgcgaagggguucuacaagaaccugaucuggcuggugaagaagggcaacagcuacccgaagcucuccaagagcuacaucaacgacaaggggaaggaggugcugguccuguggggcauccaccaccccagcaccacggccgaccagcagucccucuaccagaacgccgacaccuacguguucgugggcaccagccgguacuccaagaaguucaagcccgagaucgccauccgccccaagguccgggaccaggaggggcgcaugaacuacuacuggacccugguggagccgggcgacaagaucacguucgaggccaccgggaaccugguggucccccgguacgcguucgccauggagcgcaacgccggcagcggcaucaucaucuccgacacccccgugcacgacugcaacaccacgugccagacccccaagggggccaucaacaccagccucccguuccagaacauccaccccaucaccaucggcaagugccccaaguacgugaaguccacgaagcugcggcuggccaccgggcuccgcaacguccccagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuacccgaaguacuccgaggaggccaagcugaaccgggaggagaucgacggggugaagcuggagagcacccgcaucuaccagauccucgccaucuacuccaccgucgcgagcucccuggugcugguggucagccucggcgccaucagcuucuggaugugcuccaacggcagccugcagugccggaucugcaucuga

SEQ ID NO: 70789 - RNA, 1701 nt, Artificial Sequence; identical to SEQ ID NO: 67832
  derived and/or modified sequence opt1 from hemagglutinin__InfluenzaA__AGB13170

SEQ ID NO: 70790 - RNA, 1701 nt, Artificial Sequence
  derived and/or modified sequence opt1 from hemagglutinin__InfluenzaA__AGB13180
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacaccagcgugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 70791 - RNA, 1701 nt, Artificial Sequence; identical to SEQ ID NO: 67875
  derived and/or modified sequence opt1 from hemagglutinin__InfluenzaA__AGB13190

SEQ ID NO: 70792 - RNA, 1701 nt, Artificial Sequence
  derived and/or modified sequence opt1 from hemagglutinin__InfluenzaA__AGB13200
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgugaaguccuucuacaagaaccugaucuggcucgugaagaaggggaacagcuaccccaagcuguccaagagcuacaucaacgacaagggcaaggagguccuggugcucugggggauccaccaccccagcaccacgaccgaccagcagucccuguaccagaacgcggacgccuacguguucgucggcaccagcaaguacuccaagaaguucaagcccgagaucgccauccggccgaaggugcgcgaccaggagggccggaugaacuacuacuggacccugguggagcccggggacaagaucacguucgaggccaccggcaaccucgucgugccccgcuacgccuucgcgauggagcggaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcgccucgccaccggccugcggaacgugccgagcauccagucccgcgggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacagcgugaucgagaagaugaacacccaguucaccgccgucggcaaggaguucaaccaccuggagaagcggaucgagaaccugaacaagaagguggacgacggcuuccucgacaucuggaccuacaacgcggagcugcuggugcuccuggagaacgagcgcacgcuggacuaccacgacuccaacgucaagaaccucuacgagaaggugcggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggccaucuacuccaccguggccagcucccuggugcucgucgugagccugggggcgaucagcuucuggaugugcuccaacggcagccugcagugccgcaucugcaucuga

SEQ ID NO: 70793 - RNA, 1701 nt, Artificial Sequence
  derived and/or modified sequence opt1 from hemagglutinin__InfluenzaA__AGB13210
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccuccaaguacagcaagaaguucaagcccgagaucgccguccggccgaaggugcgcgaccaggagggccggaugaacuacuacuggacccugguggagcccggggacaagaucaccuucgaggcgacgggcaaccuccuggucccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcuccgccuggcgacgggccugcggaacgugccguccauccagagccgcggccucuucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcggaucgagaaccugaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 70794 - RNA, 1701 nt, Artificial Sequence
  derived and/or modified sequence opt1 from hemagglutinin__InfluenzaA__AGB13220
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaucagcgacaacggcacgugcuaccccggcgacuucaucaacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccacggccgaccagcagagccuguaccagaacgccgacgccuacguguucgugggcaccuccaaguacagcaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucucccugggggccaucagcuucuggaugugcagcaacggcucccugcagugccgcaucugcaucuga

SEQ ID NO: 70795 - RNA, 1701 nt, Artificial Sequence
  derived and/or modified sequence opt1 from hemagglutinin__InfluenzaA__AGB13230
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccgccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcucccuggugcucguggucagccugggggccaucagcuucuggaugugcuccaacggcagccugcagugccgcaucugcaucuga

SEQ ID NO: 70796 - RNA, 1701 nt, Artificial Sequence; identical to SEQ ID NO: 67875
  derived and/or modified sequence opt1 from hemagglutinin__InfluenzaA__AGB13240

SEQ ID NO: 70797 - RNA, 1701 nt, Artificial Sequence; identical to SEQ ID NO: 67875
  derived and/or modified sequence opt1 from hemagglutinin__InfluenzaA__AGB13250

SEQ ID NO: 70798 - RNA, 1701 nt, Artificial Sequence
  derived and/or modified sequence opt1 from hemagglutinin__InfluenzaA__AGB13260
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcuccaagagcuucuacaagaaccugaucuggcucgugaagaaggggaacuccuaccccaagcugagcaagagcuacaucaacgacaagggcaaggaggugcugguccucugggggauccaccacccgcccacguccgccgaccagcagagccuguaccagaacgcggacgccuacguguucgugggcaccucccgguacagcaagaaguucaagcccgagaucgccauccgccccaagguccgggaccaggagggccgcaugaacuacuacuggacccugguggagcccggggacaagaucaccuucgaggccacgggcaaccucguggucccccgguacgccuucgcgauggagcgcaacgccggguccggcaucaucaucagcgacaccccggugcacgacugcaacacgaccugccagacccccaagggcgccaucaacaccucccugcccuuccagaacgugcaccccaucaccaucgggaagugcccgaaguacgucaagagcaccaagcugcggcucgccacgggccugcgcaacgugcccuccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcaucaagaacgggaccuacgacuaccccaaguacuccgaggaggccaagcugaaccgggaggagaucgacggcgugaagcucgagagcacccgcaucuaccagauccuggccaucuacuccaccgucgccagcagccuggugcucguggucucccugggggcgaucagcuucuggaugugcuccaacggcagccugcagugccggaucugcaucuga

SEQ ID NO: 70799 - RNA, 1701 nt, Artificial Sequence
  derived and/or modified sequence opt1 from hemagglutinin__InfluenzaA__AGB13270
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgagaagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 70800 - RNA, 1701 nt, Artificial Sequence
  derived and/or modified sequence opt1 from hemagglutinin__InfluenzaA__AGB13280
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaacgccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacggccaggggagcggcuacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggguuccuggacaucuggaccuacaacgccgagcugcucgugcugcuggagaacgagcgcacccucgacuaccacgacuccaacgugaagaaccuguacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggcgaucuacagcaccgucgccuccagccucgugcugguggucagccugggcgccaucuccuucuggaugugcagcaacggcucccuccagugccgcaucugcaucuga

SEQ ID NO: 70801 - RNA, 1701 nt, Artificial Sequence
  derived and/or modified sequence opt1 from hemagglutinin__InfluenzaA__AGB13290
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggucaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgucagcuccuucgagcgcuucgagaucuuccccaagaccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccagcaccacggccgaccagcagucccuguaccagaacgccgacgccuacguguucgucggcaccagccgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcucccuggugcucgucgugagccugggggccaucagcuucuggaugugcuccaacggcagccugcagugccggaucugcaucuga

SEQ ID NO: 70802 - RNA, 1701 nt, Artificial Sequence; identical to SEQ ID NO: 67875
  derived and/or modified sequence opt1 from hemagglutinin__InfluenzaA__AGB13300

SEQ ID NO: 70803 - RNA, 1701 nt, Artificial Sequence
  derived and/or modified sequence opt1 from hemagglutinin__InfluenzaA__AGB13310
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucuggggcgugcaccaccccagcaccuccgccgaccagcagagccuguaccagaacgccgacgccuacguguucgucgggacgucccgguacagcaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagcacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 70804 - RNA, 1701 nt, Artificial Sequence
  derived and/or modified sequence opt1 from hemagglutinin__InfluenzaA__AGB13320
augaaggccauccuggugguccuccuguacaccaucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagaagaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcgcgcgggucuaccagauccuggccaucuacuccaccguggccagcucccuggugcucgucgugagccugggggccaucagcuucuggaugugcuccaacggcagccugcagugccgcaucugcaucuga

SEQ ID NO: 70805 - RNA, 1701 nt, Artificial Sequence
  derived and/or modified sequence opt1 from hemagglutinin__InfluenzaA__AGB13330
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaaguccuacagcaacgacaaggggaaggaggugcugguccuguggggcauccaccaccccagcaccacggccgaccagcagucccucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccagccuccccuuccagaacauccaccccaucaccaucggcaagugccccaaguacgugaaguccacgaagcugcggcuggccaccgggcuccgcaacgucccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgucgcgagcucccuggugcugguggucagccucggcgccaucagcuucuggaugugcuccaacggcagccugcagugccggaucugcaucuga

SEQ ID NO: 70806 - RNA, 1701 nt, Artificial Sequence; identical to SEQ ID NO: 67875
  derived and/or modified sequence opt1 from hemagglutinin__InfluenzaA__AGB13340

SEQ ID NO: 70807 - RNA, 1701 nt, Artificial Sequence
  derived and/or modified sequence opt1 from hemagglutinin__InfluenzaA__AGB13350
augaaggccauccuggugguccuccuguacaccuucgccaccgcgaacgccgacacgcugugcaucggcuaccacgccaacaacagcaccgagaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgcgaggagaucgacggcgugaagcuggagagcacccggaucuaccagauccuggccaucuacuccaccgucgccagcagccucgugcugguggucucccugggggccaucagcuucuggaugugcuccaacggcagccuccagugccgcaucugcaucuga

SEQ ID NO: 70808 - RNA, 1701 nt, Artificial Sequence
  derived and/or modified sequence opt1 from hemagglutinin__InfluenzaA__AGB13360
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagaugcuggugcuccuggagaacgagaagacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 70809 - RNA, 1701 nt, Artificial Sequence
  derived and/or modified sequence opt1 from hemagglutinin__InfluenzaA__AGB13380
augaaggccauccuggugguccuccuguacaccuucgccaccgcgaaggccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaaccccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 70810 - RNA, 1701 nt, Artificial Sequence; identical to SEQ ID NO: 67443
  derived and/or modified sequence opt1 from hemagglutinin__InfluenzaA__AGB13390

SEQ ID NO: 70811 - RNA, 1701 nt, Artificial Sequence; identical to SEQ ID NO: 68050
  derived and/or modified sequence opt1 from hemagglutinin__InfluenzaA__AGB13400

SEQ ID NO: 70812 - RNA, 1701 nt, Artificial Sequence; identical to SEQ ID NO: 67443
  derived and/or modified sequence opt1 from hemagglutinin__InfluenzaA__AGB13410

SEQ ID NO: 70813 - RNA, 1701 nt, Artificial Sequence; identical to SEQ ID NO: 67462
  derived and/or modified sequence opt1 from hemagglutinin__InfluenzaA__AGB13420

SEQ ID NO: 70814 - RNA, 1701 nt, Artificial Sequence
  derived and/or modified sequence opt1 from hemagglutinin__InfluenzaA__AGB13430
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagauguuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccaccaugaucuaccagauccuggccaucuacagcaccgucgcguccagccuggugcucguggucagccugggcgccaucuccuucuggaugugcagcaacggcucccugcagugccgcaucugcaucuga

SEQ ID NO: 70815 - RNA, 1701 nt, Artificial Sequence; identical to SEQ ID NO: 68050
  derived and/or modified sequence opt1 from hemagglutinin__InfluenzaA__AGB13440

SEQ ID NO: 70816 - RNA, 1701 nt, Artificial Sequence; identical to SEQ ID NO: 67462
  derived and/or modified sequence opt1 from hemagglutinin__InfluenzaA__AGB13450

SEQ ID NO: 70817 - RNA, 1701 nt, Artificial Sequence; identical to SEQ ID NO: 67443
  derived and/or modified sequence opt1 from hemagglutinin__InfluenzaA__AGB13460

SEQ ID NO: 70818 - RNA, 1701 nt, Artificial Sequence; identical to SEQ ID NO: 67875
  derived and/or modified sequence opt1 from hemagglutinin__InfluenzaA__AGB13470

SEQ ID NO: 70819 - RNA, 1701 nt, Artificial Sequence; identical to SEQ ID NO: 67462
  derived and/or modified sequence opt1 from hemagglutinin__InfluenzaA__AGB13480

SEQ ID NO: 70820 - RNA, 1701 nt, Artificial Sequence; identical to SEQ ID NO: 67875
  derived and/or modified sequence opt1 from hemagglutinin__InfluenzaA__AGB13490

SEQ ID NO: 70821 - RNA, 1701 nt, Artificial Sequence
  derived and/or modified sequence opt1 from hemagglutinin__InfluenzaA__AGB13500
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccgaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggcgccccgguacgccuucgccauggagcgcaacgccggcagcggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgugccgagcauccagucccggggccuguucggggccaucgccggcuucaucgagggcggguggacgggcauggucgacgggugguacggcuaccaccaccagaacgagcaggggagcggcuacgccgcggaccucaaguccacccagaacgccaucgacaagaucaccaacaaggugaacagcgugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggcgaagcugaaccgggaggagaucgacggggugaagcucgaguccacccgcaucuaccagauccuggccaucuacagcaccguggccuccagccugguccucguggugagccugggcgccaucuccuucuggaugugcagcaacggcucccugcagugccggaucugcaucuga

SEQ ID NO: 70822 - RNA, 1701 nt, Artificial Sequence; identical to SEQ ID NO: 68080
  derived and/or modified sequence opt1 from hemagglutinin__InfluenzaA__AGB13520

SEQ ID NO: 70823 - RNA, 1701 nt, Artificial Sequence
  derived and/or modified sequence opt1 from hemagglutinin__InfluenzaA__AGB13530
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucaacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 70824 - RNA, 1701 nt, Artificial Sequence; identical to SEQ ID NO: 68094
  derived and/or modified sequence opt1 from hemagglutinin__InfluenzaA__AGB13540

SEQ ID NO: 70825 - RNA, 1701 nt, Artificial Sequence; identical to SEQ ID NO: 68058
  derived and/or modified sequence opt1 from hemagglutinin__InfluenzaA__AGB13550

SEQ ID NO: 70826 - RNA, 1701 nt, Artificial Sequence; identical to SEQ ID NO: 68058
  derived and/or modified sequence opt1 from hemagglutinin__InfluenzaA__AGB13560

SEQ ID NO: 70827 - RNA, 1701 nt, Artificial Sequence; identical to SEQ ID NO: 67875
  derived and/or modified sequence opt1 from hemagglutinin__InfluenzaA__AGB13570

SEQ ID NO: 70828 - RNA, 1701 nt, Artificial Sequence
  derived and/or modified sequence opt1 from hemagglutinin__InfluenzaA__AGB13580
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcaacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 70829 - RNA, 1701 nt, Artificial Sequence
  derived and/or modified sequence opt1 from hemagglutinin__InfluenzaA__AGB13590
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 70830 - RNA, 1701 nt, Artificial Sequence
  derived and/or modified sequence opt1 from hemagglutinin__InfluenzaA__AGB13600
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugaacaaguccuacaucaacgacaagggcaaggaggugcugguccucugggggauccaccaccccagcaccacggccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucucccugggggccaucagcuucuggaugugcagcaacggcucccugcagugccggaucugcaucuga

SEQ ID NO: 70831 - RNA, 1701 nt, Artificial Sequence; identical to SEQ ID NO: 67875
  derived and/or modified sequence opt1 from hemagglutinin__InfluenzaA__AGB13610

SEQ ID NO: 70832 - RNA, 1701 nt, Artificial Sequence; identical to SEQ ID NO: 68094
  derived and/or modified sequence opt1 from hemagglutinin__InfluenzaA__AGB13620

SEQ ID NO: 70833 - RNA, 1701 nt, Artificial Sequence; identical to SEQ ID NO: 67462
  derived and/or modified sequence opt1 from hemagglutinin__InfluenzaA__AGB13630

SEQ ID NO: 70834 - RNA, 1701 nt, Artificial Sequence
  derived and/or modified sequence opt1 from hemagglutinin__InfluenzaA__AGB13640
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccaccaugaucuaccagauccuggccaucuacagcaccgucgcguccagccuggugcucaucgugagccugggcgccaucuccuucuggaugugcagcaacggcucccugcagugccgcaucugcaucuga

SEQ ID NO: 70835 - RNA, 1701 nt, Artificial Sequence
  derived and/or modified sequence opt1 from hemagglutinin__InfluenzaA__AGB13650
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcugauccuccuggagaacgagcggacccuggacuaccacgacuccaacgugaagaaccucuacgagaaggugcgcagccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccaccaugaucuaccagauccuggccaucuacagcaccguggcguccagccugguccucaucgugagccugggcgccaucuccuucuggaugugcagcaacggcucccugcagugccgcaucugcaucuga

SEQ ID NO: 70836 - RNA, 1701 nt, Artificial Sequence; identical to SEQ ID NO: 67832
  derived and/or modified sequence opt1 from hemagglutinin__InfluenzaA__AGB13660

SEQ ID NO: 70837 - RNA, 1701 nt, Artificial Sequence; identical to SEQ ID NO: 67443
  derived and/or modified sequence opt1 from hemagglutinin__InfluenzaA__AGB13721

SEQ ID NO: 70838 - RNA, 1701 nt, Artificial Sequence; identical to SEQ ID NO: 67875
  derived and/or modified sequence opt1 from hemagglutinin__InfluenzaA__AGB13731

SEQ ID NO: 70839 - RNA, 1701 nt, Artificial Sequence
  derived and/or modified sequence opt1 from hemagglutinin__InfluenzaA__AGB51356
augaaggccauccugcucgugcugcugugcaccuucgccgcgaccaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcugcucaccgugagcuccuggagcuacaucgucgagaccuccaacagcgacaacggcacgugcuaccccggggacuucaucaacuacgaggagcugcgggagcagcuguccagcguguccagcuucgagcgcuucgagaucuuccccaagaccuccagcuggcccaaccacgagaccaaccggggcgugaccgccgccugcccguacgccggggccaacuccuucuaccgcaaccucaucuggcuggucgagaagggcaacagcuaccccaagcuguccaagagcuacgugaacaacaaggggaaggaggugcucguccuguggggcauccaccacccgcccacguccaccgaccagcagagccuguaccagaacgcggacgccuacguguucgugggcuccagcaaguacaaccggaaguucaagcccgagaucgccgcccgccccaagguccgggggcaggccggccgcaugaacuacuacuggacccucaucgagcccggggacaccaucacguucgaggcgaccggcaaccugguggugccccgguacgccuucgccaugaaccgcggcagcggguccggcaucaucaucagcgacgccccgguccacgacugcaacaccaagugccagacccccaagggggccaucaacacgucccugcccuuccagaacauccaccccgugaccaucggcgagugcccgaaguacgucaagagcaccaagcuccggauggcgaccgggcugcgcaacauccccuccauccagagccggggccuguucggcgccaucgccggguucaucgagggcggguggacgggcaugaucgacgggugguacggcuaccaccaccagaacgagcagggcuccggguacgccgccgaccagcgcagcacccagaacgcgaucgacggcaucaccaacaaggugaacuccgugaucgagaagaugaacacccaguucacggccguggggaaggaguucaaccaccucgagaagcggaucgagaaccugaacaagaaggucgacgacggcuuccuggacaucuggaccuacaacgccgagcuccuggugcugcucgagaacgagcgcacccuggacuuccacgacagcaacgucaagaaccuguacgagaaggugcggucccagcuccgcaacaacgccaaggagaucgggaacggcugcuucgaguucuaccacaagugcgacgacacgugcauggagagcgugaagaacggcaccuacgacuaccccaaguacuccgaggagagcaagcugaaccgggaggagaucgacggggucaagcuggaguccacccgcaucuaccagauccucgccaucuacagcaccguggcguccagccuggugcugcucgucucccugggcgccaucagcuucuggaugugcagcaacgggucccugcagugccggaucugcaucuga

SEQ ID NO: 70840 - RNA, 1701 nt, Artificial Sequence
  derived and/or modified sequence opt1 from hemagglutinin__InfluenzaA__AGB97269
augaaggccauccuggugguccuccuguacaccuucgccaccgcgaacgccgacacgcugugcaucggcuaccacgccaacaacagcaccgacaccguggacaccgugcucgagaagaacaucacggucacccacuccgugaaccugcuggaggacaagcacaacgggaagcucugcaagcugcgcggcguggcgccccugcaccucgggaagugcaacaucgccggcuggauccuggggaacccggagugcgagacccugagcaccgccuccagcugguccuacaucgucgagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgugaccgccgccugcccgcacgccggcgcgaagggguucuacaagaaccugaucuggcucgucaagaagggcaacagcuaccccaagcuguccaagagcuacaucaacgacaaggggaaggaggugcuggugcucuggggcauccaccaccccuccacgaccgccgaccagcagagccuguaccagaacgccgacaccuacgucuucgugggcaccagccgguacuccaagaaguucaagcccgagaucgccauccgcccgaaggugcgggaccaggaggggcgcaugaacuacuacuggacgcuggucgagcccggcgacaagaucaccuucgaggccaccgggaaccucguggugccccgguacgcguucgccauggagcgcgacgccggcagcggcaucaucaucuccgacacccccguccacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgugccgagcauccagucccggggccuguucggggcgaucgccggcuucaucgagggcggguggaccggcauggucgacgggugguacggcuaccaccaccagaacgagcaggggagcggcuacgccgccgaccucaaguccacgcagaacgccaucgacaagaucaccaacaaggugaacagcgugaucgagaagaugaacacccaguucaccgcggucggcaaggaguucaaccaccuggagaagcgcaucgagaaccugaacaagaagguggacgacggguuccucgacaucuggacguacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggccaucuacuccaccgcggccagcucccuggugcucgucgugagccugggcgccaucuccuucuggaugugcagcaacggcagccugcagugccggaucugcaucuga

SEQ ID NO: 70841 - RNA, 1701 nt, Artificial Sequence; identical to SEQ ID NO: 69194
  derived and/or modified sequence opt1 from hemagglutinin__InfluenzaA__AGB97273

SEQ ID NO: 70842 - RNA, 1701 nt, Artificial Sequence
  derived and/or modified sequence opt1 from hemagglutinin__InfluenzaA__AGB97288
augaagaccaucaucgcccugggcuacauccucugccugguguucgcccagaagcugcccgggaacgacaacagcaccgcgacgcucugccugggccaccacgccgucccgaacgggaccaucgugaagaccaucaccaacgaccgcaucgaggugacgaacgccaccgagcugguccagaacuccagcaucggcgagaucugcgacagcccccaccagauccucgacgggaagaacugcacccugaucgacgcccugcucggcgacccccagugcgacggcuuccagaacaagaagugggaccuguucaucgagcggagcaaggccuacuccaacugcuaccccuacgacgugccggacuacgcgagccugcgcucccucguggccagcuccgggacccuggaguucaacaacgagagcuucaacuggacgggcgucacccagaacgggaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgaaguccagcggccgcaucaccgucuccaccaagcggagccagcaggccgugaucccgaacaucggcagccgcccccggauccgcaacauccccucccggaucagcaucuacuggacgaucgugaagcccggggacauccugcucaucaacuccaccggcaaccugaucgccccgcgcggguacuucaagauccggagcggcaaguccagcaucaugcgcuccgacgcccccaucggcaagugcaagagcgagugcaucacccccaacggguccauccccaacgacaagccguuccagaacgucaaccggaucaccuacggcgccugcccccgcuacgugaagcagagcacgcugaagcucgcgaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgccgaccugaaguccacccaggcggccaucgaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacaacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 70843 - RNA, 1701 nt, Artificial Sequence
  derived and/or modified sequence opt1 from hemagglutinin__InfluenzaA__AGB97292
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 70844 - RNA, 1701 nt, Artificial Sequence
  derived and/or modified sequence opt1 from hemagglutinin__InfluenzaA__AGB97300
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgcgcaagcagcugcgggagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70845 - RNA, 1701 nt, Artificial Sequence
  derived and/or modified sequence opt1 from hemagglutinin__InfluenzaA__AGE89267
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccguggaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgagaaguccuucuacaagaaccugaucuggcucgucaagaaggggaacagcuaccccaagcugaacaaguccuacaucaacgacaagggcaaggaggugcuggugcucugggggauccaccaccccagcaccagcacggaccagcagucccuguaccagaacgcggacgccuacgucuucgugggcaccagccgguacuccaagaaguucaagcccgagaucgccauccgcccgaaggugcgggaccaggagggccgcaugaacuacuacuggacccuggucgagcccggggacaagaucaccuucgaggccacgggcaaccucguggugccccgguacgccuucgcgauggagcgcaacgccgggagcggcaucaucaucuccgacacccccauccacgacugcaacacgaccugccagaccccgaagggcgccaucaacaccagccugcccuuccagaacauccaccccaucaccaucgggaagugccccaaguacgucaaguccaccaagcugcggcucgccacgggccugcgcaacgugccgagcauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacgagaucaccaacaaggucaacagcgugaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgucaagaaccucuacgagaaggucaagagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacagcaccguggccuccagccuggugcucgucgugagccugggggcgaucuccuucuggaugugcagcaacggcucccugcagugccgcaucugcaucuga

SEQ ID NO: 70846 - RNA, 1701 nt, Artificial Sequence
  derived and/or modified sequence opt1 from hemagglutinin__InfluenzaA__AGE89277
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccguggaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugaacagcguguccagcuucgagcgcuucgagaucuuccccaagaccuccagcuggcccaaccacgacuccaacaagggggugaccgccgccugcccgcacgccggcgagaaguccuucuacaagaaccugaucuggcucgucaagaaggggaacagcuaccccaagcugaacaagagcuacaucaacgacaagggcaaggaggugcuggugcucugggggauccaccaccccuccaccagcacggaccagcagagccuguaccagaacgcggacgccuacgucuucgugggcaccucccgguacagcaagaaguucaagcccgagaucgccauccgcccgaaggugcgggaccaggagggccgcaugaacuacuacuggacccuggucgagcccggggacaagaucaccuucgaggccacgggcaaccucguggugccccgguacgccuucgcgauggagcgcaacgccggguccggcaucaucaucagcgacacccccauccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacagcaacgucaagaaccucuacgagaaggugaagucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgucaagcucgagagcacccggaucuaccagauccuggccaucuacuccaccguggccagcucccuggugcucgucgugagccugggggcgaucagcuucuggaugugcuccaacggcagccugcagugccgcaucugcaucuga

SEQ ID NO: 70847 - RNA, 1701 nt, Artificial Sequence; identical to SEQ ID NO: 69364
  derived and/or modified sequence opt1 from hemagglutinin__InfluenzaA__AGE89287

SEQ ID NO: 70848 - RNA, 1701 nt, Artificial Sequence
  derived and/or modified sequence opt1 from hemagglutinin__InfluenzaA__AGE89298
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccugauccucguggugucccugggcgccaucagcuucuggaugugcagcaacggcucccugcagugccggaucugcaucuga

SEQ ID NO: 70849 - RNA, 1701 nt, Artificial Sequence; identical to SEQ ID NO: 67917
  derived and/or modified sequence opt1 from hemagglutinin__InfluenzaA__AGE89308

SEQ ID NO: 70850 - RNA, 1701 nt, Artificial Sequence; identical to SEQ ID NO: 69359
  derived and/or modified sequence opt1 from hemagglutinin__InfluenzaA__AGE89318

SEQ ID NO: 70851 - RNA, 1701 nt, Artificial Sequence
  derived and/or modified sequence opt1 from hemagglutinin__InfluenzaA__AGE89329
augaagaccaucaucgcccugagcuacauccucugccugguguucgcccagaagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 70852 - RNA, 1701 nt, Artificial Sequence; identical to SEQ ID NO: 67462
  derived and/or modified sequence opt1 from hemagglutinin__InfluenzaA__AGE89340

SEQ ID NO: 70853 - RNA, 1701 nt, Artificial Sequence; identical to SEQ ID NO: 69362
  derived and/or modified sequence opt1 from hemagglutinin__InfluenzaA__AGE89350

SEQ ID NO: 70854 - RNA, 1701 nt, Artificial Sequence
  derived and/or modified sequence opt1 from hemagglutinin__InfluenzaA__AGE89361
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacgaccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 70855 - RNA, 1701 nt, Artificial Sequence; identical to SEQ ID NO: 69359
  derived and/or modified sequence opt1 from hemagglutinin__InfluenzaA__AGE89371

SEQ ID NO: 70856 - RNA, 1701 nt, Artificial Sequence
  derived and/or modified sequence opt1 from hemagglutinin__InfluenzaA__AGE89382
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccuggugaagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 70857 - RNA, 1701 nt, Artificial Sequence
  derived and/or modified sequence opt1 from hemagglutinin__InfluenzaA__AGE89392
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 70858 - RNA, 1701 nt, Artificial Sequence; identical to SEQ ID NO: 70845
  derived and/or modified sequence opt1 from hemagglutinin__InfluenzaA__AGE89422

SEQ ID NO: 70859 - RNA, 1701 nt, Artificial Sequence; identical to SEQ ID NO: 69342
  derived and/or modified sequence opt1 from hemagglutinin__InfluenzaA__AGE89719

SEQ ID NO: 70860 - RNA, 1701 nt, Artificial Sequence
  derived and/or modified sequence opt1 from hemagglutinin__InfluenzaA__AGE89730
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacggccagggguccggcuacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggguuccuggacaucuggaccuacaacgccgagcugcucgugcugcuggagaacgagcgcacccucgacuaccacgacagcaacgugaagaaccuguacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcucaaccgcgaggagaucgacggggugaagcuggagagcacccggaucuaccagauccuggcgaucuacuccaccgucgccagcagccucgugcugguggucucccugggcgccaucagcuucuggaugugcuccaacggcagccuccagugccgcaucugcaucuga

SEQ ID NO: 70861 - RNA, 1701 nt, Artificial Sequence; identical to SEQ ID NO: 69359
  derived and/or modified sequence opt1 from hemagglutinin__InfluenzaA__AGE89740

SEQ ID NO: 70862 - RNA, 1701 nt, Artificial Sequence
  derived and/or modified sequence opt1 from hemagglutinin__InfluenzaA__AGE89751
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccggggagaucugcgacagcccccaccacauccucgacggcgagaacugcacccugaucgacgcccugcucggggacccccagugcgacggcuuccagaacaagaagugggaccuguucguggagcgcucccgggcguacuccaacugcuaccccuacgacgugccggacuacgccagccugcgcucccucgucgccagcuccggcacccuggaguucaacaacgagagcuucaacuggacgggggugacccagaacggcaccuccagcgccugcauccggcgcuccaacaacagcuucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggagccagcaggccgugaucccgaacaucggcagccgcccccggguccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgugaaccggaucaccuacggggccugcccccgcuacgucaagcagagcacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccucaagagcacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgauggagaaccagcacaccaucgaccugaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccuguccaaccgguuccagaucaagggggucgagcucaagagcggcuacaaggacuggauccuguggaucuccuucgccaucagcugcuuccugcucugcguggcgcugcugggcuucaucaugugggccugccagaaggggaacauccgcugcaacaucugcaucuga

SEQ ID NO: 70863 - RNA, 1701 nt, Artificial Sequence; identical to SEQ ID NO: 69362
  derived and/or modified sequence opt1 from hemagglutinin__InfluenzaA__AGE89762

SEQ ID NO: 70864 - RNA, 1701 nt, Artificial Sequence
  derived and/or modified sequence opt1 from hemagglutinin__InfluenzaA__AGF44891
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgguggacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 70865 - RNA, 1701 nt, Artificial Sequence; identical to SEQ ID NO: 70864
  derived and/or modified sequence opt1 from hemagglutinin__InfluenzaA__AGF44892

SEQ ID NO: 70866 - RNA, 1701 nt, Artificial Sequence
  derived and/or modified sequence opt1 from hemagglutinin__InfluenzaA__AGF44895
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70867 - RNA, 1701 nt, Artificial Sequence; identical to SEQ ID NO: 70843
  derived and/or modified sequence opt1 from hemagglutinin__InfluenzaA__AGF44896

SEQ ID NO: 70868 - RNA, 1701 nt, Artificial Sequence
  derived and/or modified sequence opt1 from hemagglutinin__InfluenzaA__AGF44897
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcaugcgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 70869 - RNA, 1701 nt, Artificial Sequence; identical to SEQ ID NO: 70866
  derived and/or modified sequence opt1 from hemagglutinin__InfluenzaA__AGF44900

SEQ ID NO: 70870 - RNA, 1701 nt, Artificial Sequence; identical to SEQ ID NO: 70866
  derived and/or modified sequence opt1 from hemagglutinin__InfluenzaA__AGF44901

SEQ ID NO: 70871 - RNA, 1701 nt, Artificial Sequence; identical to SEQ ID NO: 70866
  derived and/or modified sequence opt1 from hemagglutinin__InfluenzaA__AGF44902

SEQ ID NO: 70872 - RNA, 1701 nt, Artificial Sequence; identical to SEQ ID NO: 70866
  derived and/or modified sequence opt1 from hemagglutinin__InfluenzaA__AGF44903

SEQ ID NO: 70873 - RNA, 1701 nt, Artificial Sequence; identical to SEQ ID NO: 70866
  derived and/or modified sequence opt1 from hemagglutinin__InfluenzaA__AGF44904

SEQ ID NO: 70874 - RNA, 1701 nt, Artificial Sequence
  derived and/or modified sequence opt1 from hemagglutinin__InfluenzaA__AGF44905
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaacaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70875 - RNA, 1701 nt, Artificial Sequence; identical to SEQ ID NO: 70866
  derived and/or modified sequence opt1 from hemagglutinin__InfluenzaA__AGF44906

SEQ ID NO: 70876 - RNA, 1701 nt, Artificial Sequence
  derived and/or modified sequence opt1 from hemagglutinin__InfluenzaA__AGF44908
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 70877 - RNA, 1701 nt, Artificial Sequence; identical to SEQ ID NO: 70866
  derived and/or modified sequence opt1 from hemagglutinin__InfluenzaA__AGF44909

SEQ ID NO: 70878 - RNA, 1701 nt, Artificial Sequence; identical to SEQ ID NO: 70866
  derived and/or modified sequence opt1 from hemagglutinin__InfluenzaA__AGF44910

SEQ ID NO: 70879 - RNA, 1701 nt, Artificial Sequence
  derived and/or modified sequence opt1 from hemagglutinin__InfluenzaA__AGF44911
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaccagcugcuuccugcugugcguggcccugcucggguucaucaugugggcgugccagaagggcaacauccggugcaacaucugcaucuga

SEQ ID NO: 70880 - RNA, 1701 nt, Artificial Sequence; identical to SEQ ID NO: 70866
  derived and/or modified sequence opt1 from hemagglutinin__InfluenzaA__AGF44912

SEQ ID NO: 70881 - RNA, 1701 nt, Artificial Sequence; identical to SEQ ID NO: 70866
  derived and/or modified sequence opt1 from hemagglutinin__InfluenzaA__AGF44913

SEQ ID NO: 70882 - RNA, 1701 nt, Artificial Sequence
  derived and/or modified sequence opt1 from hemagglutinin__InfluenzaA__AGF44914
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaacaagaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 70883 - RNA, 1701 nt, Artificial Sequence; identical to SEQ ID NO: 70843
  derived and/or modified sequence opt1 from hemagglutinin__InfluenzaA__AGF44916

SEQ ID NO: 70884 - RNA, 1701 nt, Artificial Sequence
  derived and/or modified sequence opt1 from hemagglutinin__InfluenzaA__AGF44917
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgagcagaucgaggugacgaacgccaccgagcugguccagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgcggguccgacagcuccuucuucagccggcugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccggccgcaucaccgugagcacgaagcggagccagcaggccgugaucccgaacaucggcucccgcccccggauccgcaacauccccagccggaucuccaucuacuggaccaucgucaagcccggggacauccugcugaucaacagcaccggcaaccucaucgccccgcgcggguacuucaagauccgguccggcaagagcuccaucaugcgcagcgacgcccccaucggcaagugcaacuccgagugcaucacccccaacgggagcauccccaacgacaagccguuccagaacgugaaccggaucacguacggcgcgugcccccgcuacgugaagcagaacacccugaagcuggccaccgggaugcggaacguccccgagaagcagacccgcggcaucuucggggccaucgccggcuucaucgagaacggcugggaggggaugauggacggcugguacggguuccggcaccagaacuccgagggccgcgggcaggccgcggaccucaagagcacgcaggccgccaucgaccagaucaacggcaagcugaaccggcugaucggcaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgggagaacgcggaggacaugggcaacgggugcuucaagaucuaccacaagugcgacaacgccugcaucggcagcauccgcaacgggaccuacaaccacgacguguaccgcgacgaggcccugaacaaccgguuccagaucaagggcguggagcucaaguccggcuacaaggacuggauccuguggaucagcuucgccaucuccugcuuccugcucugcgucgcccugcugggguucaucaugugggcgugccagaagggcaacauccgcugcaacaucugcaucuga

SEQ ID NO: 70885 - RNA, 1701 nt, Artificial Sequence; identical to SEQ ID NO: 70843
  derived and/or modified sequence opt1 from hemagglutinin__InfluenzaA__AGF44918

SEQ ID NO: 70886 - RNA, 1701 nt, Artificial Sequence
  derived and/or modified sequence opt1 from hemagglutinin__InfluenzaA__AGF44919
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacuacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 70887 - RNA, 1701 nt, Artificial Sequence; identical to SEQ ID NO: 70843
  derived and/or modified sequence opt1 from hemagglutinin__InfluenzaA__AGF44920

SEQ ID NO: 70888 - RNA, 1701 nt, Artificial Sequence; identical to SEQ ID NO: 70866
  derived and/or modified sequence opt1 from hemagglutinin__InfluenzaA__AGF44921

SEQ ID NO: 70889 - RNA, 1701 nt, Artificial Sequence
  derived and/or modified sequence opt1 from hemagglutinin__InfluenzaA__AGG13411
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcggagcaaggcccacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggaaccagcagaccgugaucccgaacaucggcagccgcccccggguccgcaacauccccagccggguguccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgccugcaucacgcccaacggcagcauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccggaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggcgugccagaaggggaacauccgcugcaacaucugcaucuga

SEQ ID NO: 70890 - RNA, 1701 nt, Artificial Sequence
  derived and/or modified sequence opt1 from hemagglutinin__InfluenzaA__AGG13447
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcggagcaaggcccacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcagaccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagacccagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggcgugccagaaggggaacauccgcugcaacaucugcaucuga

SEQ ID NO: 70891 - RNA, 1701 nt, Artificial Sequence
  derived and/or modified sequence opt1 from hemagglutinin__InfluenzaA__AGG13459
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70892 - RNA, 1701 nt, Artificial Sequence
  derived and/or modified sequence opt1 from hemagglutinin__InfluenzaA__AGG13495
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccgacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaguccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacaaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 70893 - RNA, 1701 nt, Artificial Sequence; identical to SEQ ID NO: 70891
  derived and/or modified sequence opt1 from hemagglutinin__InfluenzaA__AGG13507

SEQ ID NO: 70894 - RNA, 1701 nt, Artificial Sequence
  derived and/or modified sequence opt1 from hemagglutinin__InfluenzaA__AGG13519
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccgacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaguccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcguccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacaaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 70895 - RNA, 1701 nt, Artificial Sequence; identical to SEQ ID NO: 70891
  derived and/or modified sequence opt1 from hemagglutinin__InfluenzaA__AGG13531

SEQ ID NO: 70896 - RNA, 1701 nt, Artificial Sequence
  derived and/or modified sequence opt1 from hemagglutinin__InfluenzaA__AGG13543
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggacaucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 70897 - RNA, 1701 nt, Artificial Sequence; identical to SEQ ID NO: 70891
  derived and/or modified sequence opt1 from hemagglutinin__InfluenzaA__AGG13555

SEQ ID NO: 70898 - RNA, 1701 nt, Artificial Sequence; identical to SEQ ID NO: 70891
  derived and/or modified sequence opt1 from hemagglutinin__InfluenzaA__AGG13567

SEQ ID NO: 70899 - RNA, 1701 nt, Artificial Sequence
  derived and/or modified sequence opt1 from hemagglutinin__InfluenzaA__AGG13591
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgagaacuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgaccggccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 70900 - RNA, 1701 nt, Artificial Sequence
  derived and/or modified sequence opt1 from hemagglutinin__InfluenzaA__AGG13615
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccuccgacaagccguuccagaacgugaaccggaucaccuacggggccugcccccgcuacgugaagcagagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 70901 - RNA, 1701 nt, Artificial Sequence; identical to SEQ ID NO: 70899
  derived and/or modified sequence opt1 from hemagglutinin__InfluenzaA__AGG13627

SEQ ID NO: 70902 - RNA, 1701 nt, Artificial Sequence
  derived and/or modified sequence opt1 from hemagglutinin__InfluenzaA__AGG13639
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacgaacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 70903 - RNA, 1701 nt, Artificial Sequence; identical to SEQ ID NO: 70892
  derived and/or modified sequence opt1 from hemagglutinin__InfluenzaA__AGG13651

SEQ ID NO: 70904 - RNA, 1701 nt, Artificial Sequence; identical to SEQ ID NO: 70891
  derived and/or modified sequence opt1 from hemagglutinin__InfluenzaA__AGG13663

SEQ ID NO: 70905 - RNA, 1701 nt, Artificial Sequence; identical to SEQ ID NO: 70892
  derived and/or modified sequence opt1 from hemagglutinin__InfluenzaA__AGG13675

SEQ ID NO: 70906 - RNA, 1701 nt, Artificial Sequence; identical to SEQ ID NO: 70891
  derived and/or modified sequence opt1 from hemagglutinin__InfluenzaA__AGG13687

SEQ ID NO: 70907 - RNA, 1701 nt, Artificial Sequence; identical to SEQ ID NO: 70892
  derived and/or modified sequence opt1 from hemagglutinin__InfluenzaA__AGG13711

SEQ ID NO: 70908 - RNA, 1701 nt, Artificial Sequence; identical to SEQ ID NO: 70891
  derived and/or modified sequence opt1 from hemagglutinin__InfluenzaA__AGG13723

SEQ ID NO: 70909 - RNA, 1701 nt, Artificial Sequence; identical to SEQ ID NO: 70891
  derived and/or modified sequence opt1 from hemagglutinin__InfluenzaA__AGG13735

SEQ ID NO: 70910 - RNA, 1701 nt, Artificial Sequence; identical to SEQ ID NO: 70891
  derived and/or modified sequence opt1 from hemagglutinin__InfluenzaA__AGG13747

SEQ ID NO: 70911 - RNA, 1701 nt, Artificial Sequence
  derived and/or modified sequence opt1 from hemagglutinin__InfluenzaA__AGG13759
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcggagcaaggcccacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggagccagcagaccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggcgugccagaaggggaacauccgcugcaacaucugcaucuga

SEQ ID NO: 70912 - RNA, 1701 nt, Artificial Sequence
  derived and/or modified sequence opt1 from hemagglutinin__InfluenzaA__AGG13771
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccgacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaguccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaacaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacaaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 70913 - RNA, 1701 nt, Artificial Sequence
  derived and/or modified sequence opt1 from hemagglutinin__InfluenzaA__AGG13783
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaugggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacguccccagccggaucuccaucuacuggaccaucgugaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgucaagcaguccacccugaagcucgccacggggaugcggaacgugcccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 70914 - RNA, 1701 nt, Artificial Sequence; identical to SEQ ID NO: 70892
  derived and/or modified sequence opt1 from hemagglutinin__InfluenzaA__AGG13795

SEQ ID NO: 70915 - RNA, 1701 nt, Artificial Sequence; identical to SEQ ID NO: 70843
  derived and/or modified sequence opt1 from hemagglutinin__InfluenzaA__AGG13807

SEQ ID NO: 70916 - RNA, 1701 nt, Artificial Sequence; identical to SEQ ID NO: 70892
  derived and/or modified sequence opt1 from hemagglutinin__InfluenzaA__AGG13819

SEQ ID NO: 70917 - RNA, 1701 nt, Artificial Sequence; identical to SEQ ID NO: 70892
  derived and/or modified sequence opt1 from hemagglutinin__InfluenzaA__AGG13831

SEQ ID NO: 70918 - RNA, 1701 nt, Artificial Sequence; identical to SEQ ID NO: 70891
  derived and/or modified sequence opt1 from hemagglutinin__InfluenzaA__AGG13855

SEQ ID NO: 70919 - RNA, 1701 nt, Artificial Sequence
  derived and/or modified sequence opt1 from hemagglutinin__InfluenzaA__AGG13867
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucgggaagaucugcgacagcccccaccagauccucgacggcgagaacugcacccugauggacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70920 - RNA, 1701 nt, Artificial Sequence; identical to SEQ ID NO: 70891
  derived and/or modified sequence opt1 from hemagglutinin__InfluenzaA__AGG13879

SEQ ID NO: 70921 - RNA, 1701 nt, Artificial Sequence; identical to SEQ ID NO: 70891
  derived and/or modified sequence opt1 from hemagglutinin__InfluenzaA__AGG13891

SEQ ID NO: 70922 - RNA, 1701 nt, Artificial Sequence
  derived and/or modified sequence opt1 from hemagglutinin__InfluenzaA__AGG13903
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccgacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaguccgugcugccgaacaucggcagccggccccgcauccggaacauccccucccgcaucagcaucuacuggaccaucgucaagcccggcgacauccuccugaucaacuccaccgggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccucaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacaaccacgacguguaccgcgacgaggcccugaacaaccgguuccagaucaagggggucgagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 70923 - RNA, 1701 nt, Artificial Sequence; identical to SEQ ID NO: 70891
  derived and/or modified sequence opt1 from hemagglutinin__InfluenzaA__AGG13927

SEQ ID NO: 70924 - RNA, 1701 nt, Artificial Sequence; identical to SEQ ID NO: 70899
  derived and/or modified sequence opt1 from hemagglutinin__InfluenzaA__AGG13939

SEQ ID NO: 70925 - RNA, 1701 nt, Artificial Sequence
  derived and/or modified sequence opt1 from hemagglutinin__InfluenzaA__AGG13962
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagggguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccacggccgaccagcagucccuguaccagaacgccgacgccuacguguucgugggcaccagccgcuacuccaagaaguucaagcccgagaucgccauccggccgaagguccgcgaccaggaggggcggaugaacuacuacuggacccugaucgagcccggcgacaagaucaccuucgaggcgacggggaaccucguggugccccgcuacgccuucgccauggagcggaacgccgagagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcucgagagcacccggaucuaccagauccuggcgaucuacuccaccguggccagcucccugguccucguggugagccugggggccaucagcuucuggaugugcuccaacggcagccugcagugccgcaucugcaucuga

SEQ ID NO: 70926 - RNA, 1701 nt, Artificial Sequence; identical to SEQ ID NO: 70891
  derived and/or modified sequence opt1 from hemagglutinin__InfluenzaA__AGG13973

SEQ ID NO: 70927 - RNA, 1701 nt, Artificial Sequence; identical to SEQ ID NO: 70891
  derived and/or modified sequence opt1 from hemagglutinin__InfluenzaA__AGG13985

SEQ ID NO: 70928 - RNA, 1701 nt, Artificial Sequence; identical to SEQ ID NO: 70891
  derived and/or modified sequence opt1 from hemagglutinin__InfluenzaA__AGG13997

SEQ ID NO: 70929 - RNA, 1701 nt, Artificial Sequence; identical to SEQ ID NO: 70891
  derived and/or modified sequence opt1 from hemagglutinin__InfluenzaA__AGG14009

SEQ ID NO: 70930 - RNA, 1701 nt, Artificial Sequence
  derived and/or modified sequence opt1 from hemagglutinin__InfluenzaA__AGG14021
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggaucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 70931 - RNA, 1701 nt, Artificial Sequence; identical to SEQ ID NO: 70892
  derived and/or modified sequence opt1 from hemagglutinin__InfluenzaA__AGG14033

SEQ ID NO: 70932 - RNA, 1701 nt, Artificial Sequence; identical to SEQ ID NO: 70911
  derived and/or modified sequence opt1 from hemagglutinin__InfluenzaA__AGG14318

SEQ ID NO: 70933 - RNA, 1701 nt, Artificial Sequence
  derived and/or modified sequence opt1 from hemagglutinin__InfluenzaA__AGG14330
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucauccgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 70934 - RNA, 1701 nt, Artificial Sequence
  derived and/or modified sequence opt1 from hemagglutinin__InfluenzaA__AGG84179
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcgccuccgagaucugcgacagcccccaccacauccucgacggggagaacugcacccugaucgacgcccugcucggcgacccccagugcgacggguuccagaacaagaagugggaccuguucguggagcgcucccgggcguacagcaacugcuaccccuacgacgugccggacuacgccucccugcgcagccucgucgccuccagcggcacccuggaguucaacaacgaguccuucaacuggacgggcgugacccagaacgggaccagcuccgccugcauccggcgcagcaacaacuccuucuucagccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccggccgcaucaccgugagcaccaagcggagccagcaggccgugaucccgaacaucgggucccgcccccggguccgcaacauccccagccggaucuccaucuacuggacgaucgugaagcccggcgacauccugcucaucaacagcaccggcaaccugaucgccccgcgcggguacuucaagauccgguccggcaagagcuccaucaugcgcagcgacgcgcccaucgggaagugcaacuccgagugcaucacccccaacggcagcauccccaacgacaagccguuccagaacgugaaccggaucaccuacggcgccugcccccgcuacgucaagcaguccacgcugaagcucgccaccgggaugcggaacgugcccgagaagcagacccgcggcaucuucggggccaucgccggcuucaucgagaacgggugggagggcaugauggacggcugguacggguuccggcaccagaacagcgagggccgcgggcaggcggccgaccugaaguccacccaggccgccaucgaccagaucaacggcaagcugaaccggcucaucgggaagacgaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagagcggguacaaggacuggauccuguggaucuccuucgccaucagcugcuuccugcugugcguggcgcugcucggcuucaucaugugggccugccagaagggcaacauccgcugcaacaucugcaucuga

SEQ ID NO: 70935 - RNA, 1704 nt, Artificial Sequence
  derived and/or modified sequence opt1 from hemagglutinin__InfluenzaA__AGI02564
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccgggaacuucaacgacuacgaggagcugaagcaccuccugucccggaucaaccacuucgagaagauccagaucauccccaagagcuccuggagcggccacgaggccuccagcggcgucuccagcgccugcccguaccaggggacgcccuccuucuuccgcaacgugguguggcugaucaagaagaacaacaccuaccccaccaucaagcggagcuacaacaacaccaaccaggaggaccuccugauccuguggggcauccaccacuccaacgacgcggccgagcagacgaagcucuaccagaacccgaccaccuacaucagcgucgggaccuccacgcugaaccagcgccuggugcccaagaucgccacccggagcaaggugaacggccaguccgggcgcauggacuucuucuggaccauccucaagcccaacgacgccaucaacuucgagagcaacggcaacuucaucgcgcccgaguacgccuacaagaucgucaagaagggcgacagcgccaucaugaaguccgagguggaguacgggaacugcaacaccaagugccagacgccgaucggcgccaucaacagcuccaugcccuuccacaacauccacccccugaccaucggggagugccccaaguacgucaagagcaacaagcuggugcucgccaccggccugcggaacuccccgcugcgcgagcggcgccggaagcgcggccucuucggggcgaucgccggcuucaucgagggcggguggcaggggaugguggacggcugguacggcuaccaccacagcaacgagcagggguccggcuacgccgccgacaaggagagcacccagaaggccaucgacggggugacgaacaaggucaacuccaucaucgacaagaugaacacccaguucgaggcggugggccgggaguucaacaaccuggagcgccggaucgagaaccugaacaagaagauggaggacggguuccucgacguguggaccuacaacgccgagcugcugguccucauggagaacgagcgcacccuggacuuccacgacagcaacgugaagaaccuguacgacaagguccggcuccagcugcgcaacaacgccaaggagcugggcaacggcugcuucgaguucuaccacaagugcgacaacgagugcauggaguccgugcggaacgggacguacgacuacccccaguacagcgaggaggcccgccucaagcgggaggagaucuccggcgugaagcuggagagcaucgggaccuaccagauccuguccaucuacagcaccgucgccuccagccucgcgcuggccaucaugguggccggccugucccucuggaugugcagcaacgggagccugcagugccgcaucugcaucuga

SEQ ID NO: 70936 - RNA, 1707 nt, Artificial Sequence
  derived and/or modified sequence opt1 from hemagglutinin__InfluenzaA__AGI02565
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccauccccgccaacgaccugugcuaccccggggacuucaacgacuacgaggagcugaagcaccuccugucccggaucaaccacuucgagaagauccagaucauccccaagagcuccuggagcaaccacgaggccucccugggcgucagcuccgcgugcccguaccucggcaagcccagcuucuuccgcaacgugguguggcugaucaagaagaacuccaccuaccccacgaucaagcggagcuacaacaacaccaaccaggaggaccugcucguccugugggggauccaccacccgaacgacgccgccgagcagaccaagcuguaccagaaccccaccacguacaucuccgugggcaccagcacccucaaccagcgccuggugcccaagaucgccacccgguccaaggucaacgggcagagcggccgcauggaguucuucuggacgauccugaagcccaacgacgcgaucaacuucgaguccaacgggaacuucaucgccccggaguacgccuacaagaucgugaagaagggcgacagcgccaucaugaaguccgagcucgaguacggcaacugcaacaccaagugccagacccccaugggggccaucaacagcagcaugcccuuccacaacauccacccccugaccaucggcgagugcccgaaguacgugaaguccaaccggcugguccucgcgacggggcugcgcaacagcccccagggcgagcggcgccggaagaagcgcggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacagcaucaucgacaagaugaacacccaguucgaggccgugggccgggaguucaacaaccucgagcgccggaucgagaaccugaacaagaagauggaggacggguuccuggacguguggacguacaacgccgagcuccugguccugauggagaacgagcgcacccucgacuuccacgacuccaacgugaagaaccuguacgacaagguccggcugcagcuccgcgacaacgccaaggagcugggcaacggcugcuucgaguucuaccacaagugcgacaacgagugcauggagagcgugcggaacgggaccuacgacuacccccaguacuccgaggaggcccgccugaagcgggaggagaucagcggcgugaagcucgaguccaucgggaccuaccagauccugagcaucuacuccacggucgcgagcucccuggcccucgccaucaugguggccggccugagccuguggaugugcuccaacgggagccuccagugccgcaucugcaucuga

SEQ ID NO: 70937 - RNA, 1704 nt, Artificial Sequence
  derived and/or modified sequence opt1 from hemagglutinin__InfluenzaA__AGI02566
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacaucagcgucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaaggagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcaccuaccagauccuguccaucuacagcacggucgcguccagccucgcccuggccaucaugguggccgggcugucccucuggaugugcagcaacggcagccugcagugccgcaucugcaucuga

SEQ ID NO: 70938 - RNA, 1707 nt, Artificial Sequence
  derived and/or modified sequence opt1 from hemagglutinin__InfluenzaA__AGI02567
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaaggccaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgcgugcccguaccagggccgcuccagcuucuuccggaacgugguguggcugaucaagaagaacaacgccuaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgcgacccggagcaaggucaacgggcaguccggccgcauggaguucuucuggaccauccugaagcccaacgacgccaucaacuucgagagcaacgggaacuucaucgcccccgaguacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggcgacggggcuccgcaacuccccgcagggcgagcggcgccggaagaagcgcggccuguucggggccaucgccggcuucaucgagggcggguggcaggggaugguggacggcugguacggcuaccaccacagcaacgagcagggguccggcuacgccgccgacaaggagagcacccagaaggcgaucgacggggugaccaacaaggucaacuccaucaucgacaagaugaacacccaguucgaggccgugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaccuaccagauccucuccaucuacagcacggucgcguccagccuggcccuggccaucaugguggccggccucucccuguggaugugcagcaacgggagccugcagugccgcaucugcaucuga

SEQ ID NO: 70939 - RNA, 1704 nt, Artificial Sequence
  derived and/or modified sequence opt1 from hemagglutinin__InfluenzaA__AGI02568
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccaccgagcagaucaagcucuaccagaacccgacgaccuacaucagcgucggcaccuccacccugaaccagcgccuggugcccaagaucgggacgcggagcaaggugaacggccaguccgggcgcauggacuucuucuggaccauccucaagcccaacgacgccaucaacuucgagagcaacggcaacuucaucgcccccgaguacgcguacaagaucgucaaggagggcgacagcgccaucaugaaguccgagguggaguacgggaacugcaacaccaagugccagaccccgaucggcgccaucaacagcuccaugcccuuccacaacauccacccccugacgaucggggagugccccaaguacgucaagagcaacaagcuggugcucgccaccggccugcggaacuccccgcugcgcgagcggcgccggaagcgcggccucuucggggccaucgcgggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacgcaguucgaggccgugggccgggaguucaacaaccuggagcgccggaucgagaaccugaacaagaagauggaggacggguuccucgacguguggaccuacaacgcggagcugcugguccucauggagaacgagcgcacccuggacuuccacgacagcaacgugaagaaccuguacgacaagguccggcuccagcugcgcgacaacgccaaggagcugggcaacggcugcuucgaguucuaccacaagugcgacaacgagugcauggaguccgugcggaacgggaccuacgacuacccccaguacagcgaggaggcccgccucaagcgggaggagaucuccggcgugaagcuggagagcauggggaucuaccagauccuguccaucuacagcacggucgccuccagccucgcccuggcgaucaugguggccggccugucccucuggaugugcagcaacgggagccugcagugccgcaucugcaucuga

SEQ ID NO: 70940 - RNA, 1683 nt, Artificial Sequence
  derived and/or modified sequence opt1 from hemagglutinin__InfluenzaA__AGI60301
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggcaucagcgggcggaucgacuuccacuggcucaugcugaaccccaacgacaccgucaccuucagcuucaacggcgcguucaucgcccccgaccgcgccuccuuccugcggggcaagagcauggggauccaguccggcguccagguggacgccaacugcgagggggacugcuaccacagcggcgggacgaucaucuccaaccuccccuuccagaacaucgacagccgcgccgugggcaagugcccgcgguacgugaagcagcgcucccugcugcucgcgaccgggaugaagaacgugcccgagauccccaagggccggggccuguucggggccaucgccggcuucaucgagaacgggugggagggccugaucgacgggugguacggcuuccgccaccagaacgcccagggcgaggggaccgccgcggacuacaagagcacccaguccgccaucgaccagaucacgggcaagcucaaccggcugaucgagaagaccaaccagcaguucgagcugaucgacaacgaguucaacgaggucgagaagcagaucgggaacgugaucaacuggacccgcgacagcaucaccgaggugugguccuacaacgccgagcuccuggucgccauggagaaccagcacacgaucgaccuggccgacagcgagauggacaagcucuacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcuguccagcggguacaaggacgugauccucugguucuccuucggcgccagcugcuucauccugcuggcgaucgugauggggcucgucuucaucugcgugaagaacggcaacaugcgcugcaccaucugcaucuga

SEQ ID NO: 70941 - RNA, 1683 nt, Artificial Sequence
  derived and/or modified sequence opt1 from hemagglutinin__InfluenzaA__AGJ72861
augaacacccagauccugguguucgcccucaucgccaucauccccaccaacgcggacaagaucugccugggccaccacgccgucagcaacgggacgaaggugaacacccugaccgagcgcggcggggagguggucaacgccaccgagacgguggagcggaccaacaucccgcgcaucugcuccaagggcaagaagaccguggaccucgggcagggcggcccccgggggaccaucacgggcccgccccagugcgaccaguuccuggaguucagcgccgaccugaucauggagcgccgggagggguccgacgucugcuaccccggcaaguucgugaacgaggaggcccuccgccagauccugcgggagagcgggggcaucgacaaggaggcgaugggcuucaccuacuccgggauccgcaccaacggcgccaccagcgccugccggcgcuccgggagcuccuucuacgccgagaugaaguggcugcucagcaacacggacaacgcggccuucccccagaugaccaaguccuacaagaacacccgcaagagccccgcccugaucguguggggcauccaccacuccgucagcaccgccgagcagacgaagcuguacggcuccgggaacaagcucgugaccgugggcagcuccaacuaccagcagagcuucguccccuccccgggggcccggccccaggugaacggccagagcgggcggaucgacuuccacuggcugaugcugaaccccaacgacaccgugaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugccguuccagaacaucgacagccgcgccgugggcaagugcccccgguacgucaagcagcgcucccugcuccuggcgaccggcaugaagaacgugcccgagauccccaaggggcggggccuguucggggccaucgccggcuucaucgagaacgggugggagggccucaucgacggcugguacggguuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgagguggagaagcagaucggcaacgucaucaacuggacccgcgacagcaucaccgaggugugguccuacaacgccgagcugcugguggccauggagaaccagcacacgaucgaccucgccgacagcgagauggacaagcuguacgagcgcgucaagcggcagcugcgcgagaacgcggaggaggacgggaccggcugcuucgagaucuuccacaagugcgacgacgacugcauggccuccauccggaacaacaccuacgaccacagcaaguaccgcgaggaggccaugcagaaccggauccagaucgacccggugaagcucuccagcggguacaaggacgucauccugugguucuccuucggcgccagcugcuucauccugcucgcgaucgugauggggcugguguucaucugcgucaagaacggcaacaugcgcugcaccaucugcaucuga

SEQ ID NO: 70942 - RNA, 1701 nt, Artificial Sequence
  derived and/or modified sequence opt1 from hemagglutinin__InfluenzaA__AGJ73327
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccaccagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucauccccgacaccccgguccacgacugcaacacgaccugccagacccccaagggcgccaucaacaccucccugcccuuccagaacauccaccccaucaccaucgggaagugcccgaaguacgucaagagcaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgugaucgagaagaugaacacgcaguucaccgccgucggcaaggaguucaaccaccuggagaagcgcaucgagaaccugaacaagaagcucgacgacggcuuccuggacaucuggaccuacaacgccgagcugcucgugcugcuggagaacgagcggacccucgacuaccacgacagcaacgucaagaaccuguacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgucaagcuggaguccacccgcaucuaccagauccuggcgaucuacagcaccguggccuccagccucgugcuggucgugucccugggggagaucagcuucuggaugugcagcaacggcucccuccagugccggaucugcaucuga

SEQ ID NO: 70943 - RNA, 1701 nt, Artificial Sequence
  derived and/or modified sequence opt1 from hemagglutinin__InfluenzaA__AGJ73329
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacgcccccgugcacgacugcaacacgaccugccagaccccgaagggggccaucaacaccucccugcccuuccagaacauccaccccaucaccaucggcaagugccccaaguacgucaagagcaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccuccagccuggugcucguggucucccugggcgccaucagcuucuggaugugcagcaacggcucccugcagugccggaucugcaucuga

SEQ ID NO: 70944 - RNA, 1701 nt, Artificial Sequence
  derived and/or modified sequence opt1 from hemagglutinin__InfluenzaA__AGJ73331
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccacccgcccacgagcgcggaccagcagucccuguaccagaacgccgacgccuacguguucgugggcaccagccgguacuccaagaaguucaagcccgagaucgccauccgccccaagguccggggccaggaggggcgcaugaacuacuacuggacccugguggagcccggcgacaagaucaccuucgaggccacggggaaccucguggucccccgguacgcguucgccauggagcgcaacgccggcagcggcaucaucaucuccgacaccccggugcacgacugcaacacgaccugccagacccccaagggggccaucaacaccagccugcccuuccagaacauccaccccaucaccaucggcaagugcccgaaguacgugaaguccaccaagcugcggcucgccacggggcugcgcaacguccccagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaaggugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucagccugggcgccaucuccuucuggaugugcagcaacggcucccugcagugccggaucugcaucuga

SEQ ID NO: 70945 - RNA, 1701 nt, Artificial Sequence
  derived and/or modified sequence opt1 from hemagglutinin__InfluenzaA__AGJ73333
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacacguacguguucgugggcaccagccgguacuccaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcagcggcaucaucaucuccgacacccccgugcacgacugcaacacgaccugccagaccccgaagggggccaucaacaccagccugcccuuccagaacauccaccccaucaccaucggcaagugccccaaguacgugaaguccaccaagcugcggcucgccacggggcugcgcaacgucccgagcauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcucccuggugcucguggucagccugggcgccaucagcuucuggaugugcuccaacggcagccugcagugccggaucugcaucuga

SEQ ID NO: 70946 - RNA, 1701 nt, Artificial Sequence
  derived and/or modified sequence opt1 from hemagglutinin__InfluenzaA__AGJ73335
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagccccgggacaagaucacguucgaggccaccgggaaccucguggucccccgcuacgcguucgccauggagcggaacgccggcagcgggaucaucaucuccgacacccccgugcacgacugcaacaccacgugccagaccccgaagggcgccaucaacaccagccugcccuuccagaacauccaccccaucaccaucggcaagugccccaaguacgugaaguccacgaagcugcgccucgccaccgggcugcggaacgucccgagcauccagucccgcggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgcgguggggaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggccaucuacuccaccgucgcgagcucccuggugcucguggucagccugggcgccaucagcuucuggaugugcuccaacgggagccugcagugccgcaucugcaucuga

SEQ ID NO: 70947 - RNA, 1701 nt, Artificial Sequence; identical to SEQ ID NO: 67462
  derived and/or modified sequence opt1 from hemagglutinin__InfluenzaA__AGJ73337

SEQ ID NO: 70948 - RNA, 1701 nt, Artificial Sequence; identical to SEQ ID NO: 67462
  derived and/or modified sequence opt1 from hemagglutinin__InfluenzaA__AGJ73339

SEQ ID NO: 70949 - RNA, 1701 nt, Artificial Sequence; identical to SEQ ID NO: 67462
  derived and/or modified sequence opt1 from hemagglutinin__InfluenzaA__AGJ73341

SEQ ID NO: 70950 - RNA, 1701 nt, Artificial Sequence
  derived and/or modified sequence opt1 from hemagglutinin__InfluenzaA__AGJ73343
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcagaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacuccaccgucgccagcagccucgugcugguggucucccugggggccaucagcuucuggaugugcuccaacggcagccuccagugccgcaucugcaucuga

SEQ ID NO: 70951 - RNA, 1701 nt, Artificial Sequence
  derived and/or modified sequence opt1 from hemagglutinin__InfluenzaA__AGJ73345
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgaggacgccuacguguucgugggcacguccaaguacagcaagaaguucaagcccgagaucgccguccggccgaaggugcgcgaccaggagggccggaugaacuacuacuggacccugguggagcccgggaacaagaucaccuucgaggccaccggcaaccuccuggucccccgcuacgcguucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggcggugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggccaucuacuccaccgucgcgagcagccucgugcugguggucucccugggggccaucagcuucuggaugugcuccaacggcagccuccagugccgcaucugcaucuga

SEQ ID NO: 70952 - RNA, 1701 nt, Artificial Sequence; identical to SEQ ID NO: 68058
  derived and/or modified sequence opt1 from hemagglutinin__InfluenzaA__AGJ73347

SEQ ID NO: 70953 - RNA, 1701 nt, Artificial Sequence; identical to SEQ ID NO: 68058
  derived and/or modified sequence opt1 from hemagglutinin__InfluenzaA__AGJ73349

SEQ ID NO: 70954 - RNA, 1701 nt, Artificial Sequence
  derived and/or modified sequence opt1 from hemagglutinin__InfluenzaA__AGJ73351
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagaugcgggaccaggaggggcgcaugaacuacuacuggacccuggucgagcccggcgacaagaucacguucgaggccaccgggaaccucguggugccccgguacgcguucgccauggagcgcaacgccggcuccggcaucaucaucagcgacacccccguccacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgugaucgagaagaugaacacccaguucaccgcggucggcaaggaguucaaccaccuggagaagcgcaucgagaaccugaacaagaagguggacgacggguuccucgacaucuggaccuacaacgccgagcugcugguccuccuggagaacgagcggacgcuggacuaccacgacagcaacgugaagaaccucuacgagaaggugcgcaaccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggccaucuacagcaccguggcguccagccugguccucguggugucccugggcgccaucagcuucuggaugugcagcaacggcucccugcagugccggaucugcaucuga

SEQ ID NO: 70955 - RNA, 1701 nt, Artificial Sequence
  derived and/or modified sequence opt1 from hemagglutinin__InfluenzaA__AGJ73353
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagagcauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgcgaggagaucgacggcgugaagcuggaguccacccggaucuaccagauccuggcgaucuacagcaccgucgccagcucccucgugcugguggucagccugggggccaucuccuucuggaugugcagcaacggcucccuccagugccgcaucugcaucuga

SEQ ID NO: 70956 - RNA, 1701 nt, Artificial Sequence
  derived and/or modified sequence opt1 from hemagglutinin__InfluenzaA__AGJ73355
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcguccagccuggugcucguggucucccugggcgccaccagcuucuggaugugcagcaacggcucccugcagugccggaucugcaucuga

SEQ ID NO: 70957 - RNA, 1701 nt, Artificial Sequence; identical to SEQ ID NO: 67875
  derived and/or modified sequence opt1 from hemagglutinin__InfluenzaA__AGJ73357

SEQ ID NO: 70958 - RNA, 1701 nt, Artificial Sequence
  derived and/or modified sequence opt1 from hemagglutinin__InfluenzaA__AGJ73361
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccagcuccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagggguucuacaagaaccugaucuggcucgugaagaagggcaacagcuaccccaagcuguccaagagcuacaucaacgacaaggggaaggaggugcugguccucuggggcauccaccaccccagcaccacggcggaccagcagucccuguaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccucguggucccccgguacgccuucgcgauggagcgcaacgccggcagcggcaucuucaucuccgacacccccgugcacgacugcaacaccacgugccagaccccgaagggggccaucaacaccagccugcccuuccagaacauccaccccaucaccaucggcaagugccccaaguacgugaaguccacgaagcugcggcucgccaccgggcugcgcaacgucccgagcauccagucccggggccuguucggggccaucgcgggcuucaucgagggcggguggaccggcaugguggacgggugguacggcuaccaccaccagaacgagcaggggagcggcuacgccgccgaccucaaguccacccagaacgccaucgacaagaucacgaacaaggugaacagcgucaucgagaagaugaacacccaguucaccgccgugggcaaggaguucaaccaccuggagaagcgcaucgagaaccugaacaagaaggucgacgacggguuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgccagcucccuggugcucguggucagccugggcgcgaucagcuucuggaugugcuccaacggcagccugcagugccggaucugcaucuga

SEQ ID NO: 70959 - RNA, 1701 nt, Artificial Sequence; identical to SEQ ID NO: 68058
  derived and/or modified sequence opt1 from hemagglutinin__InfluenzaA__AGJ73363

SEQ ID NO: 70960 - RNA, 1701 nt, Artificial Sequence; identical to SEQ ID NO: 67875
  derived and/or modified sequence opt1 from hemagglutinin__InfluenzaA__AGJ73365

SEQ ID NO: 70961 - RNA, 1701 nt, Artificial Sequence
  derived and/or modified sequence opt1 from hemagglutinin__InfluenzaA__AGJ73367
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggcccuacaucguggagaccagcuccagcgacaacggcacgugcuaccccggcgacuucaucaacuacgaggagcuccgggagcagcuguccagcguguccagcuucgagcgcuucgagaucuuccccaagaccuccagcuggccgaaccacgacuccaacaagggggucgccgccgccugcccccacgcgggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcaccagcaaguacuccaagaaguucaagccggagaucgcgguccggcccaaggugcgcgaccaggagggccggaugaacuacuacuggacgcugguggagcccggggacaagaucaccuucgaggccaccggcaaccuccuggucccccgcuacgccuucgccauggagcggaacgccgggagcggcaucaucaucuccgacaccccggugcaggacugcaacacgaccugccagacccccaagggcgcgaucaacaccagccugcccuuccagaacauccaccccaucacgaucgggaagugcccgaaguacgugaaguccaccaagcuccgccuggccaccggccugcggaacguccccagcauccagucccgcggccucuucggggccaucgccggguucaucgagggcggcuggaccgggaugguggacggcugguacggguaccaccaccagaacgagcagggcagcggguacgccgcggaccugaaguccacgcagaacgccaucgacaagaucaccaacaaggugaacagcgucaucgagaagaugaacacccaguucaccgccgugggcaaggaguucaaccaccuggagaagcggaucgagaaccucaacaagaaggucgacgacggcuuccuggacaucuggacguacaacgccgagcugcucgugcugcuggagaacgagcgcacccucgacuaccacgacuccaacgugaagaaccuguacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgcgaggagaucgacggcgugaagcuggagagcacccggaucuaccagauccuggccaucuacuccaccgucgccagcucccucgugcugguggucagccugggggccaucagcuucuggaugugcuccaacggcagccuccagugccgcaucugcaucuga

SEQ ID NO: 70962 - RNA, 1701 nt, Artificial Sequence
  derived and/or modified sequence opt1 from hemagglutinin__InfluenzaA__AGJ73369
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgccgaggccaagcugaaccgggaggagaucgacggggugaagcucgaguccacccgcaucuaccagauccuggcgaucuacagcaccgucgccuccagccuggugcucguggucucccugggcgccaucagcuucuggaugugcagcaacggcucccugcagugccggaucugcaucuga

SEQ ID NO: 70963 - RNA, 1701 nt, Artificial Sequence; identical to SEQ ID NO: 67462
  derived and/or modified sequence opt1 from hemagglutinin__InfluenzaA__AGJ73371

SEQ ID NO: 70964 - RNA, 1701 nt, Artificial Sequence
  derived and/or modified sequence opt1 from hemagglutinin__InfluenzaA__AGJ73373
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacacccccgugcacgacugcaacaccacgugccagaccccgaagggggccaucaacaccucccaccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcguccagccuggugcugguggucucccucggcgccaucagcuucuggaugugcagcaacggcucccugcagugccggaucugcaucuga

SEQ ID NO: 70965 - RNA, 1701 nt, Artificial Sequence
  derived and/or modified sequence opt1 from hemagglutinin__InfluenzaA__AGJ73375
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccgagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 70966 - RNA, 1701 nt, Artificial Sequence
  derived and/or modified sequence opt1 from hemagglutinin__InfluenzaA__AGJ73377
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccuccugcccgcgggccggcgccaagagcuucuacaagaaccugaucuggcucgugaagaaggggaacuccuaccccaagcugagcaagagcuacaucaacgacaagggcaaggaggugcugguccucugggggauccaccaccccuccaccacggcggaccagcagagccuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucaccuucgaggccacgggcaaccuccuggugccccgcuacgcguucgccauggagcggaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagagcaccaagcuccgccuggccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgugaucgagaagaugaacacgcaguucaccgcggucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacagcaacgugaagaaccuguacgagaaggugcggaaccagcugaagaacaacgccaaggagaucgggaacggcugcuucgaguucaaccacaagugcgacaacacgugcauggaguccgucaagaacgggaccuacgacuaccccaaguacagcgaggaggccaagcucaacaaggaggagaucgacggcgugaagcuggaguccacccgcaucuaccagauccuggccaucuacagcaccguggcguccagccucguccugguggugagccugggggccaucuccuucuggaugugcagcaacggcucccuccagugccggaucugcaucuga

SEQ ID NO: 70967 - RNA, 1701 nt, Artificial Sequence
  derived and/or modified sequence opt1 from hemagglutinin__InfluenzaA__AGJ73380
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccggggccaggaggggcgcaugaacuacuacuggacccugaucgagcccggcgacaagaucaccuucgaggcgacggggaaccucguggugccccgguacgccuucgccauggagcgcaacgccggcagcggcaucaucaucuccgacacccccguccacgacugcaacagcacgugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcuguucguccugcucgagaacgagcggacccuggacuaccacgacagcaacgugaaggaccuguacgagaaggugcgcaaccagcucaagaacaacgccaaggagaucggcaacgggugcuucgaguucuaccacaagugcgacaacacgugcauggaguccgucaagaacggcaccuacgacuaccccaaguacagcgaggaggccaagcugaaccgggagaagaucgacggggugaagcuggaguccacccgcaucuaccagauccucgcgaucuacagcaccguggccuccagccugguccugguggugagccucggcgccaucuccuucuggaugugcagcaacggcucccugcagugccggaucugcaucuga

SEQ ID NO: 70968 - RNA, 1701 nt, Artificial Sequence
  derived and/or modified sequence opt1 from hemagglutinin__InfluenzaA__AGK62991
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcauccggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggcgugcccccgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacaaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 70969 - RNA, 1701 nt, Artificial Sequence
  derived and/or modified sequence opt1 from hemagglutinin__InfluenzaA__AGK62993
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucagcaagugcaacuccgcgugcaucaccacgaacggcagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacuccgagggccgggggcaggcggccgaccugaaguccacccaggccgccaucgaccagaucaacggcaagcugaaccgccucaucgggaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucagcuucgccaucuccugcuuccuccugugcgucgcgcugcucggcuucaucauguggagcugccagaagggcaacauccggugcaacaucugcaucuga

SEQ ID NO: 70970 - RNA, 1701 nt, Artificial Sequence
  derived and/or modified sequence opt1 from hemagglutinin__InfluenzaA__AGK62995
augaagaccaucaucgcccugagcuacauccucugccugguguucgcccagaagcugcccggcaacgacaacuccaccgcgacgcucugccuggggcaccacgccggcccgaacgggaccaucgucaagaccaucaccaacgaccagaucgaggugacgaacgccaccgagcuggugcagagcuccagcaccggcgagaucugcgacagcccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcagagcuccggccggaucaccgucagcacgaagcgcagccagcaggccgugaucccgaacaucggcucccggccccgcauccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgucaaccgcaucacguacggcgccugcccccgguacgugaagcaguccacccugaagcucgcgaccgggaugcgcaacgugcccgagaagcagacccggggcaucuucggggccaucgccggcuucaucgagaacggcugggaggggauggucgacggcugguacggguuccgccaccagaacagcgagggccgggggcaggccgccgaccugaaguccacgcaggcggccaucgaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 70971 - RNA, 1701 nt, Artificial Sequence
  derived and/or modified sequence opt1 from hemagglutinin__InfluenzaA__AGK62997
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgacaaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacgugcggggccugcgcccgguacgugaagcagaacacccugaagcucgccaccggcaugcgcaacgugcccgagaagcagacccgggggaucuucggcgccaucgcggucuucaucgagaacgggugggagggcaugguggacggcugguacggguuccgccaccagaacagcgagggccgggagcaggccgccgccuuccaguccacgcaggccgcgaucgaccagaucaucgggaagcugaaccgccugaucggcgagaccaacgagaaguuccaccagaucgagaaggaguucagcgagguggagcggcgcauccaggcccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggcuccauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcucugcguggcccugcugggcuucaucaugugguccugccagaaggggaacauccgcugcaacaucugcaucuga

SEQ ID NO: 70972 - RNA, 1701 nt, Artificial Sequence
  derived and/or modified sequence opt1 from hemagglutinin__InfluenzaA__AGK62999
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 70973 - RNA, 1701 nt, Artificial Sequence
  derived and/or modified sequence opt1 from hemagglutinin__InfluenzaA__AGK63001
augaagaccaucaucgcccugagcuacauccucugccugguguucgcccagaagcugcccggcaacgacaacuccaccgcgacgcucugccugguccaccacgccgugccgaacgggaccaucgugaagaccaucaccaacgaccagaucgaggucacgaacgccaccgagcuggugcagagcuccagcaccggcgagaucugcgacagcccccaccagauccucgacggggagaacugcacccugaucgacgcccugcucggcgacccccagugcgacggguuccagaacaaggagugggaccuguucguggagcgcuccaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacggccucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcgggcggaucaccgugagcacgaagcgcucccagcaggccgucaucccgaacaucggcagccggccccgcauccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagagcacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcgggagcaggccgccgacuuccagagcacgcaggcggccaucgaccagaucaucggcaagcugaaccgccugaucgggaagaccaacgagaaguuccaccagaucgagaaggaguucuccgaggucgagcggcgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacggcugcuucaagaucuaccacaagugcgacaacgcgugcaucgggagcauccggaacggcaccuacaaccacgacgucuaccgcgacgaggcccugaacaaccgguuccagaucaaggggguggagcucaaguccggcuacaaggacuggauccuguggaucagcuucgccaucagcugcuuccugcucugcguggcccugcugggguucaucaugugguccugccagaagggcaacauccgcugcaacaucugcaucuga

SEQ ID NO: 70974 - RNA, 1701 nt, Artificial Sequence
  derived and/or modified sequence opt1 from hemagglutinin__InfluenzaA__AGK63003
augaagaccaucaucgcccugagcuacauccucugccugguguucgcccagaagcugcccggcaacgacaacuccaccgcgacgcucugccuggggcaccacgccggcccgaacgggaccaucgucaagaccaucaccaacgaccagaucgaggugacgaacgccaccgagcuggugcagagcuccagcaccggcgagaucugcgacagcccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcauccgccgguccaacagcuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcggccggaucaccgugagcacgaagcgcucccagcaggccgucaucccgaacaucggcagccggccccgcauccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgccugcaucacccccaacggguccauccccaacgacaagccguuccagaacgugaaccgcaucacguacggcgcgugcccccgguacgucaagcagagcacccugaagcucgccaccgggaugcgcaacgugcccgagaagcagacccggggcaucuucggggccaucgccggcuucaucgagaacggcugggaggggaugguggacggcugguacggguuccgccaccagaacuccgagggccgggggcaggccgcggaccugaaguccacgcaggccgccaucgaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacaaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 70975 - RNA, 1701 nt, Artificial Sequence
  derived and/or modified sequence opt1 from hemagglutinin__InfluenzaA__AGK63005
augaagaccaucaucgcccugagcuacauccucugccugguguucgcccagaagcugcccggcaacgacaacuccaccgcgacgcucugccugguccaccacgccgugccgaacgggaccaucgugaagaccaucaccaacgaccagaucgaggucacgaacgccaccgagcuggugcagagcuccagcaccggcgagaucugcgacagcccccaccagauccucgacggggagaacugcacccugaucgacgcccugcucggcgacccccagugcgacggguuccagaacaagaagugggaccuguucguggagcgcuccaaggccuacuccaacugcuaccccuacgacgucccggacuacgcgagccugcggucccucguggccagcuccggcacgcuggaguucaacaacgagagcuucaacuggaccggcgugacccagaacgggaccuccagcgccugcauccgccgguccaacagcuccuucuucagccgccugaacggccucacgcaccugaacuucaaguaccccgcccuggacgucaccaugcccaacaacgacaaguucgacaagcucuacaucuggggcgugcaccaccccgggaccgacaaggaccagaucuuccuguacgcgcaguccagcgggcggaucaccgugagcacgaagcgcucccagcaggccgucaucccgaacaucggcagccggccccgcauccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagagcacccugaagcucgcgaccggcaugcgcaacgugcccgagaagcagacccgggggaucuucggcgccaucgccguguucaucgagaacgggugggagggcauggucgacggcugguacggguuccgccaccagaacuccgagggccgggagcaggccgccgacuuccagagcacgcaggcggccaucgaccagaucaacgggaagcugaaccgccugaucggcaagaccaacgagaaguuccaccagaucgagaaggaguucuccgagguggaggggcggauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacaugggcaacggcugcuucaagaucuaccacaagugcgacaacgcgugcaucgggagcauccgcaacggcaccuacaaccacgacguguaccgggacgaggcccugaacaaccgcuuccagaucaaggggguggagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 70976 - RNA, 1701 nt, Artificial Sequence
  derived and/or modified sequence opt1 from hemagglutinin__InfluenzaA__AGK63007
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 70977 - RNA, 1701 nt, Artificial Sequence
  derived and/or modified sequence opt1 from hemagglutinin__InfluenzaA__AGK63009
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggccugcagaacaagaagugggaccuguucguggagcgcagcaaggcccacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaacaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccuccugaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 70978 - RNA, 1701 nt, Artificial Sequence
  derived and/or modified sequence opt1 from hemagglutinin__InfluenzaA__AGK63011
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagagcacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 70979 - RNA, 1701 nt, Artificial Sequence
  derived and/or modified sequence opt1 from hemagglutinin__InfluenzaA__AGK63013
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccuggacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcgcccgguacgugaagcagaacacccugaagcucgccaccggcaugcgcaacgugcccgagaagcagacccgggggaucuucggcgccaucgcggucuucaucgagaacgggugggagggcaugguggacggcugguacggguuccgccaccagaacagcgagggccgggggcaggccgccgcccugcaguccacgcaggccgcgaucgaccagaucaccggcaagcugaaccgccucaucggggagaccaacgagaaguuccaccagaucgagaaggaguucagcgagguggagggccggauccaggcccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugguccugccagaagggcaacauccggugcaacaucugcaucuga

SEQ ID NO: 70980 - RNA, 1701 nt, Artificial Sequence
  derived and/or modified sequence opt1 from hemagglutinin__InfluenzaA__AGK63015
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcaaguccaacagcuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcgcaucaccgugagcacgaagcggucccagcaggccgugaucccgaacaucggcagccgcccccggauccgcaacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 70981 - RNA, 1701 nt, Artificial Sequence; identical to SEQ ID NO: 67990
  derived and/or modified sequence opt1 from hemagglutinin__InfluenzaA__AGK63017

SEQ ID NO: 70982 - RNA, 1701 nt, Artificial Sequence
  derived and/or modified sequence opt1 from hemagglutinin__InfluenzaA__AGK63019
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 70983 - RNA, 1701 nt, Artificial Sequence; identical to SEQ ID NO: 70857
  derived and/or modified sequence opt1 from hemagglutinin__InfluenzaA__AGK63021

SEQ ID NO: 70984 - RNA, 1701 nt, Artificial Sequence
  derived and/or modified sequence opt1 from hemagglutinin__InfluenzaA__AGK63025
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgagccugcggucccucguggccagcuccggcacgcuggaguucaacaacgagagcuucaacuggaccggggucacccagaacggcaccuccagcgccugcauccgcaaguccaacagcuccuucuucagccggcugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaguccagcgggcgcaucaccgucagcacgaagcggucccagcaggccgugaucccgaacaucggcagccgcccccggauccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgucaaccggaucacguacggggccugcccccgcuacgugaagcagagcacccugaagcucgcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacaaccacgacguguaccgcgacgaggcccucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 70985 - RNA, 1701 nt, Artificial Sequence; identical to SEQ ID NO: 70082
  derived and/or modified sequence opt1 from hemagglutinin__InfluenzaA__AGK63027

SEQ ID NO: 70986 - RNA, 1701 nt, Artificial Sequence
  derived and/or modified sequence opt1 from hemagglutinin__InfluenzaA__AGK63029
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucaccacgaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 70987 - RNA, 1701 nt, Artificial Sequence
  derived and/or modified sequence opt1 from hemagglutinin__InfluenzaA__AGK63031
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaagaagaagugggaccuguucguggagcgcuccaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaucaugcccaacaacgagcaguucgacaagcucuacaucuggggcguccaccaccccgggaccgacaaggaccagaucuuccuguacgcgcaggccagcgggcggaucaccguguccaccaagcgcagccagcaggccgugaucccgaacaucggcagccggccccgcguccggaacauccccucccgcgugagcaucuacuggacgaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagacgaacgagaagcugcaccagaucgagaaggaguucagcgagguggagggccggauccuggaccucgagaaguacguggaggacaccaagaucgaccugugguccuacaacgccgagcugcucgucgcgcuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucuccuucgccaucagcugcuuccugcucugcgucgcgcugcugggcuucaucaugugggccugccagaaggggaacauccggugcaacaucugcaucuga

SEQ ID NO: 70988 - RNA, 1701 nt, Artificial Sequence
  derived and/or modified sequence opt1 from hemagglutinin__InfluenzaA__AGK63033
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccugaucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcaaguccaacagcuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcgcaucaccgugagcacgaagcggagccagcaggccgugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacccccaacggcagcauccccaacgacaagccguuccagaacgugaaccggaucacguacggggcgugcccccgcuacgugaagcaguccacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 70989 - RNA, 1701 nt, Artificial Sequence
  derived and/or modified sequence opt1 from hemagglutinin__InfluenzaA__AGK63035
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgugaagcagagcacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 70990 - RNA, 1701 nt, Artificial Sequence
  derived and/or modified sequence opt1 from hemagglutinin__InfluenzaA__AGK63037
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcaaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgcccagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 70991 - RNA, 1701 nt, Artificial Sequence
  derived and/or modified sequence opt1 from hemagglutinin__InfluenzaA__AGK63039
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaagaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugacccuccccaacaacgagcaguucgacaagcuguacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccuccugaucaacuccaccgggaaccugaucgccccgcggggcuacuucaagauccgcagcgggaaguccagcaucaugcgguccgacgcccccaucagcaagugcaacuccgcgugcaucacccccaacggcagcauccccaacgacaagccguuccagaacgucaaccgcaucacguacggcgccugcccccgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacuccgagggccgggggcaggcggccgaccugaaguccacgcaggccgccaucgaccagaucaacggcaagcucaaccgccugaucgggaagaccaacgagaaguuccaccagaucgagaaggaguucuccgagguggagggccggauccaggaccuggagaaguacguggaggacaccaagaucgaccucuggagcuacaacgccgagcugcuggucgcgcucgagaaccagcacaccaucgaccugacggacuccgagaugaacaagcuguucgagaagaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgcgcuccugggcuucaucauguggagcugccagaagggcaacauccggugcaacaucugcaucuga

SEQ ID NO: 70992 - RNA, 1701 nt, Artificial Sequence
  derived and/or modified sequence opt1 from hemagglutinin__InfluenzaA__AGK63041
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggccugcagaacaagaagugggaccugaucguggagcgcagcaaggcccacuccuacugcuaccccuacgacgugccggacuacgcgagccuccggucccuggucgccagcuccggcacgcuggaguucaacaacgagagcuucaacuggaccgaggugacccagaacgggaccuccagcgccugcauccgccgguccaacaacagcuucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcggccggaucaccguguccacgaagcgcagccagcaggccgugaucccgaacaucgggagccggccccgcguccggaacauccccucccgcgugagcaucuacuggaccaucgugaagcccggcgacauccuccugaucaacuccaccggcaaccugaucgccccgcggggguacuucaagauccgcagcggcaaguccagcaucaugcgguccgacgcccccaucgggaagugcaacagcgcgugcaucacccccaacggcuccauccccaacgacaagccguuccagaacgucaaccgcaucacguacggcgccugcccccgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggccgggggcaggcggccgaccugaaguccacgcaggccgccaucgaccagaucaacggcaagcucaaccgccugaucgggaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucuccuucgccaucagcugcuuccugcugugcgucgcgcuccugggcuucaucaugugggccugccagaagggcaacauccggugcaacaucugcaucuga

SEQ ID NO: 70993 - RNA, 1701 nt, Artificial Sequence
  derived and/or modified sequence opt1 from hemagglutinin__InfluenzaA__AGK63043
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagagcacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 70994 - RNA, 1701 nt, Artificial Sequence
  derived and/or modified sequence opt1 from hemagglutinin__InfluenzaA__AGK63045
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaagaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcaaguccaacagcuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcgcaucaccgugagcacgaagcggagccagcaggccgugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacccccaacggcagcauccccaacgacaagccguuccagaacgugaaccggaucacguacggggcgugcccccgcuacgugaagcaguccacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgcccagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 70995 - RNA, 1701 nt, Artificial Sequence
  derived and/or modified sequence opt1 from hemagglutinin__InfluenzaA__AGK63047
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccgcgagggccggaugaacuacuacuggacccugaucgagcccggggacaagaucaccuucgaggcgacgggcaaccucguggugccccgcuacgccuucgccauggagcggaacgccgggagcggcaucaucaucuccgacacccccguccacgacugcaacaccgccugccagaccccggagggcgcgaucaacacgagccugcccuuccagaacauccaccccaucaccaucgggaagugccccaaguacgugaaguccaccaagcugcgccucgccaccggccugcggaacgugccgagcauccagucccgcgggcuguucggcgccaucgccggguucaucgagggcggcuggacggggauggucgacggcugguacggguaccaccaccagaacgagcagggcagcggguacgccgcggaccucaaguccacccagaacgccaucgacaagaucaccaacaaggugaacagcgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgcgagaagaucgacggcgugaagcucgagagcacccggaucuaccagauccuggccaucuacuccaccguggccagcucccugguccucguggugagccugggggccaucagcuucuggaugugcuccaacggcagccugcagugccgcaucugcaucuga

SEQ ID NO: 70996 - RNA, 1683 nt, Artificial Sequence
  derived and/or modified sequence opt1 from hemagglutinin__InfluenzaA__AGK82158
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 70997 - RNA, 1683 nt, Artificial Sequence
  derived and/or modified sequence opt1 from hemagglutinin__InfluenzaA__AGK84857
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccgcagaucaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgcguucaucgcccccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaggggaccgccgcggacuacaagagcacccaguccgccaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgcggaggaggacggcaccggcugcuucgagaucuuccacaagugcgacgacgacugcauggccuccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgcgaucgugauggggcuggucuucaucugcgugaagaacggcaacaugcgcugcaccaucugcaucuga

SEQ ID NO: 70998 - RNA, 1683 nt, Artificial Sequence
  derived and/or modified sequence opt1 from hemagglutinin__InfluenzaA__AGK84860
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagaugaccgucgaccucggccagugcgggcugcugggcaccaucacgggcccgccccagugcgaccaguuccucgaguucagcgccgaccugaucaucgagcggcgcgagggguccgacgugugcuaccccggcaaguucgugaacgaggaggcccugcggcagauccuccgcgagagcgggggcaucgacaaggaggcgaugggguucaccuacuccggcauccggaccaacggcgccaccagcgccugccgccgguccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcgcaucgacuuccacuggcugaugcugaaccccaacgacaccgucaccuucagcuucaacggcgcguucaucgcccccgaccgggccuccuuccuccgcggcaagagcauggggauccaguccggcguccagguggacgccaacugcgagggggacugcuaccacagcggcgggacgaucaucuccaaccugcccuuccagaacaucgacagccgggccgugggcaagugcccgcgcuacgugaagcagcggucccugcuccuggcgaccgggaugaagaacgugcccgagauccccaagggccgcggccuguucggggccaucgccggcuucaucgagaacgggugggagggccucaucgacgggugguacggcuuccggcaccagaacgcccagggcgaggggaccgccgcggacuacaagagcacccaguccgccaucgaccagaucacgggcaagcugaaccgccugaucgagaagaccaaccagcaguucgagcucaucgacaacgaguucaacgaggucgagaagcagaucgggaacgugaucaacuggacccgggacagcaucaccgaggugugguccuacaacgccgagcugcuggucgccauggagaaccagcacacgaucgaccucgccgacagcgagauggacaagcuguacgagcgcgugaagcgccagcugcgggagaacgcggaggaggacggcaccggcugcuucgagaucuuccacaagugcgacgacgacugcauggccuccauccgcaacaacaccuacgaccacagcaaguaccgggaggaggccaugcagaaccgcauccagaucgaccccgucaagcucuccagcggguacaaggacgugauccugugguucuccuucggcgccagcugcuucauccugcucgcgaucgugauggggcuggucuucaucugcgugaagaacggcaacaugcggugcaccaucugcaucuga

SEQ ID NO: 70999 - RNA, 1683 nt, Artificial Sequence
  derived and/or modified sequence opt1 from hemagglutinin__InfluenzaA__AGK84863
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagaagaccgucgaccucggccagugcgggcugcugggcaccaucacgggcccgccccagugcgaccaguuccucgaguucagcgccgaccugaucaucgagcggcgcgagggguccgacgugugcuaccccggcaaguucgugaacgaggaggcccugcggcagauccuccgcgagagcgggggcaucgacaaggaggcgaugggguucaccuacuccggcauccggaccaacggcgccaccagcgccugccgccgguccgggagcuccuucuacgccgagaugaaguggcugcugagcaacacggacaacgcggccuucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcgcaucgacuuccacuggcugaugcugaaccccaacgacaccgucaccuucagcuucaacggcgcguucaucgcccccgaccgggccuccuuccuccgcggcaagagcauggggauccaguccggcguccagguggacgccaacugcgagggggacugcuaccacagcggcgggacgaucaucuccaaccugcccuuccagaacaucgacagccgggccgugggcaagugcccgcgcuacgugaagcagcggucccugcuccuggcgaccgggaugaagaacgugcccgagauccccaagggccgcggccuguucggggccaucgccggcuucaucgagaacgggugggagggccucaucgacgggugguacggcuuccggcaccagaacgcccagggcgaggggaccgccgcggacuacaagagcacccaguccgccaucgaccagaucacgggcaagcugaaccgccugaucgagaagaccaaccagcaguucgagcucaucgacaacgaguucaacgaggucgagaagcagaucgggaacgugaucaacuggacccgggacagcaucaccgaggugugguccuacaacgccgagcugcuggucgccauggagaaccagcacacgaucgaccucgccgacagcgagauggacaagcuguacgagcgcgugaagcgccagcugcgggagaacgcggaggaggacggcaccggcugcuucgagaucuuccacaagugcgacgacgacugcauggccuccauccgcaacaacaccuacgaccacagcaaguaccgggaggaggccaugcagaaccgcauccagaucgaccccgucaagcucuccagcggguacaaggacgugauccugugguucuccuucggcgccagcugcuucauccugcucgcgaucgugauggggcuggucuucaucugcgugaagaacggcaacaugcggugcaccaucugcaucuga

SEQ ID NO: 71000 - RNA, 1701 nt, Artificial Sequence
  derived and/or modified sequence opt1 from hemagglutinin__InfluenzaA__AGL07713
augaaggccauccuggugguccuccuguacaccuucgccaccgcgaacgccgacacgcugugcaucggcuaccacgccaacaacagcaccgacaccguggacaccgugcucgagaagaacgucacggugacccgcuccgugaaccugcuggaggacaagcacaacgggaagcucugcaagcugcggggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccgggagcuggcccaaccacgacuccaacaagggcgucaccgccgccugcccgcacgccggggcgaagggcuucuacaagaaccugaucuggcucguggagaaggggaacagcuaccccaagcuguccaagagcuacaucaacgacaagggcaaggaggugcugguccucuggggcauccaccaccccuccaccacggccgaccagcagcgccuguaccagaacgccgacaccuacguguucguggggaccagccgguacagcaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggcuccgggaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcggcucgccaccggccugcgcaacgugccguccauccagagccgggggcuguucggcgcgaucgccggcuucaucgagggcggguggaccgggaugguggacggcugguacggguaccaccaccagaacgagcagggcuccggcuacgccgccgaccucaagagcacccagaacgccaucgacaagaucacgaacaaggugaacuccgucaucgagaagaugaacacccaguucaccgcgguggggaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucucccugggcgccaucagcuucuggaugugcuccaacgggagccugcagugccggaucugcaucuga

SEQ ID NO: 71001 - RNA, 1701 nt, Artificial Sequence
  derived and/or modified sequence opt1 from hemagglutinin__InfluenzaA__AGL09731
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71002 - RNA, 1701 nt, Artificial Sequence
  derived and/or modified sequence opt1 from hemagglutinin__InfluenzaA__AGL09732
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71003 - RNA, 1701 nt, Artificial Sequence
  derived and/or modified sequence opt1 from hemagglutinin__InfluenzaA__AGL09734
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucaucgagcgguccaaggccuacagcaacugcuaccccuacgacgugccggacuacgcgucccugcgcagccugguggccuccagcggcacccucgaguucaacaacgaguccuucaacuggacgggggucacccagaacggcaccagcuccgccugcauccggcgcagcaacuccagcuucuucucccggcugaacuggcugacccaccucaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 71004 - RNA, 1701 nt, Artificial Sequence
  derived and/or modified sequence opt1 from hemagglutinin__InfluenzaA__AGL09735
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucagcaucuga

SEQ ID NO: 71005 - RNA, 1701 nt, Artificial Sequence
  derived and/or modified sequence opt1 from hemagglutinin__InfluenzaA__AGL09736
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 71006 - RNA, 1701 nt, Artificial Sequence; identical to SEQ ID NO: 70891
  derived and/or modified sequence opt1 from hemagglutinin__InfluenzaA__AGL09737

SEQ ID NO: 71007 - RNA, 1701 nt, Artificial Sequence
  derived and/or modified sequence opt1 from hemagglutinin__InfluenzaA__AGL09739
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcuccugcuaccccuacgacgugccggacuacgcgagccugcgcucccucgucgccagcuccggcacccuggaguucaacaacgagagcuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccgugagcaccaagcggucccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 71008 - RNA, 1701 nt, Artificial Sequence; identical to SEQ ID NO: 70843
  derived and/or modified sequence opt1 from hemagglutinin__InfluenzaA__AGL09740

SEQ ID NO: 71009 - RNA, 1701 nt, Artificial Sequence; identical to SEQ ID NO: 70082
  derived and/or modified sequence opt1 from hemagglutinin__InfluenzaA__AGL09741

SEQ ID NO: 71010 - RNA, 1701 nt, Artificial Sequence
  derived and/or modified sequence opt1 from hemagglutinin__InfluenzaA__AGL09742
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagacccagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugcggagcggcuacaaggacuggauccuguggaucuccuucgccaucagcugcuuccuccugugcgucgcgcugcucggcuucaucaugugggccugccagaaggggaacauccgcugcuccaucugcaucuga

SEQ ID NO: 71011 - RNA, 1701 nt, Artificial Sequence; identical to SEQ ID NO: 70866
  derived and/or modified sequence opt1 from hemagglutinin__InfluenzaA__AGL09744

SEQ ID NO: 71012 - RNA, 1701 nt, Artificial Sequence
  derived and/or modified sequence opt1 from hemagglutinin__InfluenzaA__AGL09745
augaagaccaucaucgcccugagcuacauccucugccugguguucgcccagaagcugcccggcaacgacaacuccaccgcgacccucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacguggggaacggcugcuucaagaucuaccacaagugcgacaacacgugcaucggguccauccggaacggcaccuacgaccacaacgucuaccgcgacgaggcgcucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 71013 - RNA, 1701 nt, Artificial Sequence; identical to SEQ ID NO: 71005
  derived and/or modified sequence opt1 from hemagglutinin__InfluenzaA__AGL09746

SEQ ID NO: 71014 - RNA, 1701 nt, Artificial Sequence; identical to SEQ ID NO: 70843
  derived and/or modified sequence opt1 from hemagglutinin__InfluenzaA__AGL09747

SEQ ID NO: 71015 - RNA, 1701 nt, Artificial Sequence; identical to SEQ ID NO: 70866
  derived and/or modified sequence opt1 from hemagglutinin__InfluenzaA__AGL09748

SEQ ID NO: 71016 - RNA, 1701 nt, Artificial Sequence; identical to SEQ ID NO: 70864
  derived and/or modified sequence opt1 from hemagglutinin__InfluenzaA__AGL09749

SEQ ID NO: 71017 - RNA, 1701 nt, Artificial Sequence; identical to SEQ ID NO: 71002
  derived and/or modified sequence opt1 from hemagglutinin__InfluenzaA__AGL09750

SEQ ID NO: 71018 - RNA, 1701 nt, Artificial Sequence; identical to SEQ ID NO: 70843
  derived and/or modified sequence opt1 from hemagglutinin__InfluenzaA__AGL09751

SEQ ID NO: 71019 - RNA, 1701 nt, Artificial Sequence; identical to SEQ ID NO: 71002
  derived and/or modified sequence opt1 from hemagglutinin__InfluenzaA__AGL09753

SEQ ID NO: 71020 - RNA, 1701 nt, Artificial Sequence
  derived and/or modified sequence opt1 from hemagglutinin__InfluenzaA__AGL09754
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugccugcugcugugcguggcccuccugggcuucaucaugugggccugccagaaggggaacauccgcugcaacaucugcaucuga

SEQ ID NO: 71021 - RNA, 1701 nt, Artificial Sequence; identical to SEQ ID NO: 71005
  derived and/or modified sequence opt1 from hemagglutinin__InfluenzaA__AGL09756

SEQ ID NO: 71022 - RNA, 1701 nt, Artificial Sequence
  derived and/or modified sequence opt1 from hemagglutinin__InfluenzaA__AGL09758
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagaucugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaacuccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacaccaccgugcacgacugcaacacgaccugccagacccccaagggggccaucaacaccucccucccguuccagaacauccaccccaucacgaucggcaagugccccaaguacgucaagagcaccaagcugcggcuggccaccgggcuccgcaacgugcccuccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccuggacaucuggacguacaacgccgagcuccuggugcugcucgagaacgagcggacccuggacuaccacgacagcaacgugaagaaccuguacgagaagguccgcaaccagcucaagaacaacgccaaggagaucggcaacgggugcuucgaguucuaccacaagugcgacaacaugugcauggaguccgugaagaacggcaccuacgacuacccgaaguacagcgaggaggccaagcugaaccgggagaagaucgacggggugaagcuggaguccacccgcaucuaccagauccucgccaucuacagcacggucgcguccagccuggugcugguggucucccucggcgccaucagcuucuggaugugcagcaacggcucccugcagugccggaucugcaucuga

SEQ ID NO: 71023 - RNA, 1701 nt, Artificial Sequence
  derived and/or modified sequence opt1 from hemagglutinin__InfluenzaA__AGL09760
augaagaccaucaucgccgugagcuacauccugugccucgucuucgcccaggagcugcccggcaacgacgacuccaccgcgacgcugugccucgggcaccacgccgugccgaacggcaccaucgugaagaccaucaccaacgaccagaucgaggucacgaacgccaccgagcuggugcagagcuccagcaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgucccggacuacgcgagccugcggucccugguggccagcuccggcacgcucgaguucaacaacgagagcuucaacuggaccggggugacccagaacggcaccuccagcgccugcauccgccgguccaacaacagcuucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccagcgggcggaucaccguguccacgaagcgcagccagcaggccgucaucccgaacaucggcagccggccccgcgugcggaacauccccucccgcgugagcaucuacuggaccaucgucaagcccggcgacauccugcugaucaacuccaccgggaaccucaucgccccgcggggcuacuucaagauccgcagcgggaaguccagcaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccucaaguccacgcaggccgccaucgaccagaucaacgggaagcugaaccgccugaucggcaagaccaacgagaaguuccaccagaucgagaaggaguucagcgagguggagggccggauccaggaccucgagaaguacgucgaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcgcugcugggcuucaucaugugggccugccagaaggggaacauccggugcaacaucugcaucuga

SEQ ID NO: 71024 - RNA, 1701 nt, Artificial Sequence; identical to SEQ ID NO: 70876
  derived and/or modified sequence opt1 from hemagglutinin__InfluenzaA__AGL09761

SEQ ID NO: 71025 - RNA, 1701 nt, Artificial Sequence
  derived and/or modified sequence opt1 from hemagglutinin__InfluenzaA__AGL09762
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgcgggagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggagccagcaggccgugaucccgaacaucggcucccgcccccggauccgcaacauccccagccggaucuccaucuacuggacgaucgucaagcccggggacauccugcucaucaacagcaccggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 71026 - RNA, 1701 nt, Artificial Sequence; identical to SEQ ID NO: 71002
  derived and/or modified sequence opt1 from hemagglutinin__InfluenzaA__AGL09763

SEQ ID NO: 71027 - RNA, 1701 nt, Artificial Sequence
  derived and/or modified sequence opt1 from hemagglutinin__InfluenzaA__AGL09764
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacccucgaguucaacaacgaguccuucaacuggacgggggugacccagaacggcaccagcuccgccugcauccgccggagcaacuccagcuucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcggaucaccgugagcaccaagcgcagccagcaggccgugaucccgaacaucggcucccggccccgcauccggaacauccccagccgcaucuccaucuacuggacgaucgucaagcccggcgacauccugcugaucaacagcaccgggaaccucaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcuggcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagacgaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 71028 - RNA, 1701 nt, Artificial Sequence; identical to SEQ ID NO: 70866
  derived and/or modified sequence opt1 from hemagglutinin__InfluenzaA__AGL09765

SEQ ID NO: 71029 - RNA, 1701 nt, Artificial Sequence
  derived and/or modified sequence opt1 from hemagglutinin__InfluenzaA__AGL09766
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccuguccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccucaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccggaacgggacguacgaccacgacguguaccgcgacgaggcccugaacaaccgcuuccagaucaagggcgucgagcucaagagcggcuacaaggacuggauccuguggaucuccuucgccaucagcugcuuccugcugugcguggcccuccugggguucaucaugugggcgugccagaagggcaacauccggugcaacaucugcaucuga

SEQ ID NO: 71030 - RNA, 1701 nt, Artificial Sequence
  derived and/or modified sequence opt1 from hemagglutinin__InfluenzaA__AGL09767
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacaacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71031 - RNA, 1701 nt, Artificial Sequence
  derived and/or modified sequence opt1 from hemagglutinin__InfluenzaA__AGL09769
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcaacuccagcuucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcugaucaacagcaccggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagacgaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 71032 - RNA, 1701 nt, Artificial Sequence; identical to SEQ ID NO: 70866
  derived and/or modified sequence opt1 from hemagglutinin__InfluenzaA__AGL09770

SEQ ID NO: 71033 - RNA, 1701 nt, Artificial Sequence
  derived and/or modified sequence opt1 from hemagglutinin__InfluenzaA__AGL09771
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacaucuaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 71034 - RNA, 1701 nt, Artificial Sequence
  derived and/or modified sequence opt1 from hemagglutinin__InfluenzaA__AGL09772
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacuacguguaccgggacgaggcccucaacaaccgcuuccagaucaaggggguggagcugaaguccggcuacaaggacuggauccuguggaucagcuucgcgaccuccugcuuccuccugugcgucgcccugcucggcuucaucaugugggccugccagaaggggaacauccggugcaacaucugcaucuga

SEQ ID NO: 71035 - RNA, 1701 nt, Artificial Sequence
  derived and/or modified sequence opt1 from hemagglutinin__InfluenzaA__AGL09773
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccgaggugacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccggccggaucaccgugagcacgaagcgcucccagcaggccgugaucccgaacaucgggagccggccccgcguccggaacauccccagccgcguguccaucuacuggaccaucgugaagcccggcgacauccugcucaucaacagcaccggcaaccugaucgccccgcggggguacuucaagauccgcuccggcaagagcuccaucaugcggagcgacgcgcccaucgggaagugcaacuccgccugcaucacccccaacggcagcauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgcgggcuucaucgagaacgggugggagggcauggucgacggcugguacggguuccgccaccagaacuccgagggccgggggcaggccgccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcagcauccgcaacgggaccuacgaccacuacguguaccgggacgaggcccucaacaaccgcuuccagaucaagggcguggagcugaaguccggguacaaggacuggauccuguggaucagcuucgcgaccuccugcuuccuccugugcgucgcccugcucggcuucaucaugugggccugccagaagggcaacauccggugcaacaucugcaucuga

SEQ ID NO: 71036 - RNA, 1701 nt, Artificial Sequence; identical to SEQ ID NO: 71034
  derived and/or modified sequence opt1 from hemagglutinin__InfluenzaA__AGL09774

SEQ ID NO: 71037 - RNA, 1701 nt, Artificial Sequence; identical to SEQ ID NO: 70876
  derived and/or modified sequence opt1 from hemagglutinin__InfluenzaA__AGL09775

SEQ ID NO: 71038 - RNA, 1701 nt, Artificial Sequence; identical to SEQ ID NO: 71034
  derived and/or modified sequence opt1 from hemagglutinin__InfluenzaA__AGL09776

SEQ ID NO: 71039 - RNA, 1701 nt, Artificial Sequence; identical to SEQ ID NO: 71034
  derived and/or modified sequence opt1 from hemagglutinin__InfluenzaA__AGL09777

SEQ ID NO: 71040 - RNA, 1701 nt, Artificial Sequence
  derived and/or modified sequence opt1 from hemagglutinin__InfluenzaA__AGL09778
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccgcaucgaggugacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucgucgagcgguccaaggccuacagcaacugcuaccccuacgacgugccggacuacgcgucccugcgcagccucguggccuccagcggcacccuggaguucaacaacgaguccuucaacugggccggggucacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcgugcaccaccccgggacggacaaggaccagaucuuccuguacgcccagagcuccggccggaucaccgucagcaccaagcgcagccagcaggccgugaucccgaacaucggcucccggccccgcauccggaacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71041 - RNA, 1701 nt, Artificial Sequence
  derived and/or modified sequence opt1 from hemagglutinin__InfluenzaA__AGL09779
augaagaccaucaucgcccugagcuacauccucugccugguguucgcccagaagcugcccggcaacaacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71042 - RNA, 1701 nt, Artificial Sequence
  derived and/or modified sequence opt1 from hemagglutinin__InfluenzaA__AGL09780
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucgacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucagccuguacgcccaguccagcggccggaucaccgugagcaccaagcgcucccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 71043 - RNA, 1701 nt, Artificial Sequence; identical to SEQ ID NO: 71001
  derived and/or modified sequence opt1 from hemagglutinin__InfluenzaA__AGL09781

SEQ ID NO: 71044 - RNA, 1701 nt, Artificial Sequence; identical to SEQ ID NO: 70866
  derived and/or modified sequence opt1 from hemagglutinin__InfluenzaA__AGL09782

SEQ ID NO: 71045 - RNA, 1701 nt, Artificial Sequence
  derived and/or modified sequence opt1 from hemagglutinin__InfluenzaA__AGL09783
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccagcgggcgcaucaccguguccaccaagcggagccagcaggccgucaucccgaacaucggcagccgcccccggauccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcacccagaaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 71046 - RNA, 1701 nt, Artificial Sequence; identical to SEQ ID NO: 70876
  derived and/or modified sequence opt1 from hemagglutinin__InfluenzaA__AGL09785

SEQ ID NO: 71047 - RNA, 1701 nt, Artificial Sequence
  derived and/or modified sequence opt1 from hemagglutinin__InfluenzaA__AGL09786
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucgacaacgaguccuucaacugggccggggugacgcagaacggcaccagcuccgccugcauccgggggagcaaguccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucagccuguacgcccaguccagcggccggaucaccgugagcaccaagcgcucccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgcgugcccccgguacgugaagcagagcacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 71048 - RNA, 1701 nt, Artificial Sequence
  derived and/or modified sequence opt1 from hemagglutinin__InfluenzaA__AGL09787
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 71049 - RNA, 1701 nt, Artificial Sequence; identical to SEQ ID NO: 71048
  derived and/or modified sequence opt1 from hemagglutinin__InfluenzaA__AGL09788

SEQ ID NO: 71050 - RNA, 1701 nt, Artificial Sequence; identical to SEQ ID NO: 71048
  derived and/or modified sequence opt1 from hemagglutinin__InfluenzaA__AGL09789

SEQ ID NO: 71051 - RNA, 1701 nt, Artificial Sequence; identical to SEQ ID NO: 71002
  derived and/or modified sequence opt1 from hemagglutinin__InfluenzaA__AGL09790

SEQ ID NO: 71052 - RNA, 1701 nt, Artificial Sequence
  derived and/or modified sequence opt1 from hemagglutinin__InfluenzaA__AGL09791
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacaugacgaugcccaacaacgagcaguucgacaagcucuacaucuggggcgugcaccaccccgggaccgacaaggaccagaucagccuguacgcgcaguccagcgggcgcaucaccgucagcaccaagcggucccagcaggccgugaucccgaacaucggcagccgcccccggauccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgucaaccggaucaccuacggggccugcccccgcuacgugaagcagagcacgcugaagcucgcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 71053 - RNA, 1701 nt, Artificial Sequence; identical to SEQ ID NO: 71002
  derived and/or modified sequence opt1 from hemagglutinin__InfluenzaA__AGL09792

SEQ ID NO: 71054 - RNA, 1701 nt, Artificial Sequence
  derived and/or modified sequence opt1 from hemagglutinin__InfluenzaA__AGL09794
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacacccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 71055 - RNA, 1701 nt, Artificial Sequence; identical to SEQ ID NO: 71002
  derived and/or modified sequence opt1 from hemagglutinin__InfluenzaA__AGL09795

SEQ ID NO: 71056 - RNA, 1701 nt, Artificial Sequence
  derived and/or modified sequence opt1 from hemagglutinin__InfluenzaA__AGL09797
augaagaccaucaucgcccugagcuacauccucugccugguguucucccagaagcugcccggcaacgacaacagcaccgccacgcucugccuggggcaccacgcggucccgaacggcaccaucgugaagaccaucaccaacgaccgcaucgaggugacgaacgccaccgagcugguccagaacuccagcaucggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgccagccugcgcucccucgucgcgagcuccggcacccuggaguucaacaacgagagcuucaacugggccggggugacgcagaacggcaccuccagcgccugcauccggggguccaacagcuccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcggccggaucaccgugagcaccaagcgcucccagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagagcgagugcaucacccccaacggguccauccccaacgacaagccguuccagaacgugaaccgcaucaccuacggcgccugcccccgguacgugaagcagagcacccugaagcucgcgacggggaugcgcaacguccccgagaagcagacccggggcaucuucggggccaucgccggcuucaucgagaacggcugggaggggaugguggacggcugguacggguuccgccaccagaacuccgagggccgggggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 71057 - RNA, 1701 nt, Artificial Sequence
  derived and/or modified sequence opt1 from hemagglutinin__InfluenzaA__AGL09798
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacuucgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacuacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 71058 - RNA, 1701 nt, Artificial Sequence; identical to SEQ ID NO: 71056
  derived and/or modified sequence opt1 from hemagglutinin__InfluenzaA__AGL09799

SEQ ID NO: 71059 - RNA, 1701 nt, Artificial Sequence; identical to SEQ ID NO: 71002
  derived and/or modified sequence opt1 from hemagglutinin__InfluenzaA__AGL09800

SEQ ID NO: 71060 - RNA, 1701 nt, Artificial Sequence; identical to SEQ ID NO: 70866
  derived and/or modified sequence opt1 from hemagglutinin__InfluenzaA__AGL09801

SEQ ID NO: 71061 - RNA, 1701 nt, Artificial Sequence; identical to SEQ ID NO: 70866
  derived and/or modified sequence opt1 from hemagglutinin__InfluenzaA__AGL09802

SEQ ID NO: 71062 - RNA, 1701 nt, Artificial Sequence
  derived and/or modified sequence opt1 from hemagglutinin__InfluenzaA__AGL09803
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcagcggacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 71063 - RNA, 1701 nt, Artificial Sequence; identical to SEQ ID NO: 70899
  derived and/or modified sequence opt1 from hemagglutinin__InfluenzaA__AGL09804

SEQ ID NO: 71064 - RNA, 1701 nt, Artificial Sequence; identical to SEQ ID NO: 71005
  derived and/or modified sequence opt1 from hemagglutinin__InfluenzaA__AGL09805

SEQ ID NO: 71065 - RNA, 1701 nt, Artificial Sequence; identical to SEQ ID NO: 71034
  derived and/or modified sequence opt1 from hemagglutinin__InfluenzaA__AGL09806

SEQ ID NO: 71066 - RNA, 1701 nt, Artificial Sequence; identical to SEQ ID NO: 71005
  derived and/or modified sequence opt1 from hemagglutinin__InfluenzaA__AGL09807

SEQ ID NO: 71067 - RNA, 1701 nt, Artificial Sequence
  derived and/or modified sequence opt1 from hemagglutinin__InfluenzaA__AGL09808
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacgucggcucccgcccccggauccgcaacauccccagccggaucuccaucuacuggaccaucgugaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgucaagcaguccacccugaagcucgccacggggaugcggaacgugcccgagaagcagacccgcggcaucuucggggccaucgccggcuucaucgagaacggcugggaggggaugguggacggcugguacggguuccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 71068 - RNA, 1701 nt, Artificial Sequence
  derived and/or modified sequence opt1 from hemagglutinin__InfluenzaA__AGL09809
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcuggugaagaaggggaacagcuaccccaagcucuccaucagcuacaucaacgacaagggcaaggaggugcugguccuguggggcauccaccaccccuccaccacggccgaccagcagagccucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacuccaccgcggccagcucccugguccugguggugagccucggcgccaucuccuucuggaugugcagcaacgggagccugcagugccggaucugcaucuga

SEQ ID NO: 71069 - RNA, 1701 nt, Artificial Sequence
  derived and/or modified sequence opt1 from hemagglutinin__InfluenzaA__AGL09810
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucuccaacgagagcuucaacuggacgggggugacccagaacggcaccuccagcgccugcauccggcgcuccaacagcuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccgugagcaccaagcggucccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacgggacgugcccccgcuacgugaagcagagcacccugaagcucgccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagagcacgcaggccgcgaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcauggggagcauccggaacggcaccuacgaccacgacguguaccgcgacgaggcgcucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 71070 - RNA, 1701 nt, Artificial Sequence; identical to SEQ ID NO: 70866
  derived and/or modified sequence opt1 from hemagglutinin__InfluenzaA__AGL09811

SEQ ID NO: 71071 - RNA, 1701 nt, Artificial Sequence
  derived and/or modified sequence opt1 from hemagglutinin__InfluenzaA__AGL09812
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccaggacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71072 - RNA, 1701 nt, Artificial Sequence; identical to SEQ ID NO: 70843
  derived and/or modified sequence opt1 from hemagglutinin__InfluenzaA__AGL09813

SEQ ID NO: 71073 - RNA, 1701 nt, Artificial Sequence; identical to SEQ ID NO: 70891
  derived and/or modified sequence opt1 from hemagglutinin__InfluenzaA__AGL09814

SEQ ID NO: 71074 - RNA, 1701 nt, Artificial Sequence
  derived and/or modified sequence opt1 from hemagglutinin__InfluenzaA__AGL09815
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcagcauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 71075 - RNA, 1701 nt, Artificial Sequence; identical to SEQ ID NO: 70891
  derived and/or modified sequence opt1 from hemagglutinin__InfluenzaA__AGL09816

SEQ ID NO: 71076 - RNA, 1701 nt, Artificial Sequence
  derived and/or modified sequence opt1 from hemagglutinin__InfluenzaA__AGL09817
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacagcgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71077 - RNA, 1701 nt, Artificial Sequence; identical to SEQ ID NO: 70891
  derived and/or modified sequence opt1 from hemagglutinin__InfluenzaA__AGL09818

SEQ ID NO: 71078 - RNA, 1701 nt, Artificial Sequence; identical to SEQ ID NO: 71002
  derived and/or modified sequence opt1 from hemagglutinin__InfluenzaA__AGL09819

SEQ ID NO: 71079 - RNA, 1701 nt, Artificial Sequence
  derived and/or modified sequence opt1 from hemagglutinin__InfluenzaA__AGL09820
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacuggacgggggugacccagaacggcaccagcuccgccugcauccgcgggagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggagccagcaggccgugaucccgaacaucggcucccgcccccggauccgcaacauccccagccggaucuccaucuacuggacgaucgucaagcccggggacauccugcucaucaacagcaccggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagacgaacgagaaguuccaccagaucgagaaggaguucagcgagaucgaggggcgcauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcguggagcucaagagcggcuacaaggacuggauccuguggaucuccuucgccaucagcugcuuccugcugugcgucgcccugcucggguucaucaugugggccugccagaagggcaacauccgcugcaacaucugcaucuga

SEQ ID NO: 71080 - RNA, 1701 nt, Artificial Sequence
  derived and/or modified sequence opt1 from hemagglutinin__InfluenzaA__AGL09821
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggaucgagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 71081 - RNA, 1701 nt, Artificial Sequence; identical to SEQ ID NO: 71005
  derived and/or modified sequence opt1 from hemagglutinin__InfluenzaA__AGL09822

SEQ ID NO: 71082 - RNA, 1701 nt, Artificial Sequence; identical to SEQ ID NO: 71048
  derived and/or modified sequence opt1 from hemagglutinin__InfluenzaA__AGL09823

SEQ ID NO: 71083 - RNA, 1701 nt, Artificial Sequence
  derived and/or modified sequence opt1 from hemagglutinin__InfluenzaA__AGL09824
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcaccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 71084 - RNA, 1701 nt, Artificial Sequence; identical to SEQ ID NO: 71002
  derived and/or modified sequence opt1 from hemagglutinin__InfluenzaA__AGL09825

SEQ ID NO: 71085 - RNA, 1701 nt, Artificial Sequence; identical to SEQ ID NO: 71083
  derived and/or modified sequence opt1 from hemagglutinin__InfluenzaA__AGL09826

SEQ ID NO: 71086 - RNA, 1701 nt, Artificial Sequence; identical to SEQ ID NO: 70876
  derived and/or modified sequence opt1 from hemagglutinin__InfluenzaA__AGL09827

SEQ ID NO: 71087 - RNA, 1701 nt, Artificial Sequence
  derived and/or modified sequence opt1 from hemagglutinin__InfluenzaA__AGL09828
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacccuggaguucaacaacgaguccuucaacugggccggggugacgcagaacggcaccagcuccgccugcauccgcgggagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggagccagcaggccgugaucccgaacaucggcucccgcccccggauccgcaacauccccagccggaucuccaucuacuggaccaucgucaagcccggggacauccugcucaucaacagcacgggcaaccugaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguaccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 71088 - RNA, 1701 nt, Artificial Sequence
  derived and/or modified sequence opt1 from hemagglutinin__InfluenzaA__AGL09829
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccuggaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71089 - RNA, 1701 nt, Artificial Sequence; identical to SEQ ID NO: 70891
  derived and/or modified sequence opt1 from hemagglutinin__InfluenzaA__AGL09830

SEQ ID NO: 71090 - RNA, 1701 nt, Artificial Sequence; identical to SEQ ID NO: 71001
  derived and/or modified sequence opt1 from hemagglutinin__InfluenzaA__AGL09831

SEQ ID NO: 71091 - RNA, 1701 nt, Artificial Sequence
  derived and/or modified sequence opt1 from hemagglutinin__InfluenzaA__AGL09832
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccacagcaacuucaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugagcaccaagcggucccagcaggccgugaucccgaacaucggcagccgcccccggauccgcaacauccccucccggaucagcaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggaccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71092 - RNA, 1701 nt, Artificial Sequence; identical to SEQ ID NO: 71002
  derived and/or modified sequence opt1 from hemagglutinin__InfluenzaA__AGL09833

SEQ ID NO: 71093 - RNA, 1701 nt, Artificial Sequence
  derived and/or modified sequence opt1 from hemagglutinin__InfluenzaA__AGL09881
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcgccagcuccgcgugcauccgggggagcaacuccagcuucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccagagcuccggccggaucacggugagcaccaagcgcagccagcaggccgugaucccgaacaucggcucccggccccgcauccggaacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcgcccaucggcaagugcaaguccgagugcaucacgcccaacgggagcauccccaacgacaagccguuccagaacgugaaccgcaucaccuacggcgccugcccccgguacgugaagcaguccacccugaagcucgccaccgggaugcgcaacguccccgagaagcagacgcggggcaucuucggggccaucgccggcuucaucgagaacggcugggaggggaugguggacggcugguacggguuccgccaccagaacagcgagggccgggggcaggcggccgaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacaccaagaucgaccugugguccuacaacgccgagcuccugguggcgcuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcgcugcucggguucaucaugugggccugccagaagggcaacauccggugcaacaucugcaucuga

SEQ ID NO: 71094 - RNA, 1701 nt, Artificial Sequence; identical to SEQ ID NO: 70866
  derived and/or modified sequence opt1 from hemagglutinin__InfluenzaA__AGL09882

SEQ ID NO: 71095 - RNA, 1701 nt, Artificial Sequence; identical to SEQ ID NO: 70843
  derived and/or modified sequence opt1 from hemagglutinin__InfluenzaA__AGL09883

SEQ ID NO: 71096 - RNA, 1701 nt, Artificial Sequence; identical to SEQ ID NO: 70843
  derived and/or modified sequence opt1 from hemagglutinin__InfluenzaA__AGL09884

SEQ ID NO: 71097 - RNA, 1683 nt, Artificial Sequence; identical to SEQ ID NO: 70996
  derived and/or modified sequence opt1 from hemagglutinin__InfluenzaA__AGL44438

SEQ ID NO: 71098 - RNA, 1701 nt, Artificial Sequence
  derived and/or modified sequence opt1 from hemagglutinin__InfluenzaA__AGN69267
augaaggccauccuggugguccuccuguacaccuucaccacgggcaacgccgacacccugugcaucggguaccacgcgaacaacagcaccgacaccguggacacggugcucgagaagaacgucaccgugacccacuccgugaaccugcuggaggaccgccacaacggcaagcucugcaagcugcgcggggucgcgccccugcaccucggcaagugcaacaucgccggguggcugcugggcaacccggagugcgagcuccuguucaccgccagcuccuggagcuacaucguggagacguccaacagcgacaacgggaccugcuaccccggggacuucaucaacuacgaggagcugcgggagcagcucuccagcguguccagcuucgagcgguucgagaucuuccccaaggccuccagcuggcccaaccacgagaccaaccgcggcgucaccgccgccugcccguacgccggggccaacuccuucuaccggaaccugaucuggcuggugaagaagggcaacagcuaccccaagcucuccaagagcuacaucaacaacaaggagaaggaggugcugguccugugggggauccaccacccgcccacguccaccgaccagcagagccucuaccagaacgcggacgccuacguguucgugggcuccagcaaguacagcaagaaguucaagcccgagaucgccacccgccccaagguccggggccaggccgggcgcaugaacuacuacuggacccugguggagcccggcgacacgaucaccuucgaggccaccgggaaccugguggucccccgguacgcguucgccaugaagcgcggcuccggcagcgggaucaucaucuccgacaccccggugcacgacugcaacacgaccugccagacccccaagggcgccaucaacaccagccuccccuuccagaacauccaccccgugacgaucggggagugcccgaaguacgucaaguccaccaagcugcggauggccaccggccugcgcaacauccccagcauccagucccggggccucuucggcgccaucgcgggcuucaucgagggcggguggaccgggaugaucgacggcugguacggguaccaccaccagaacgagcagggcagcggcuacgccgccgaccgcaaguccacgcagaacgccaucgacgggaucaccaacaaggugaacagcgugaucgagaagaugaacacccaguucaccgccgucggcaaggaguucaaccaccuggagaagcggaucgagaaccugaacaagaagguggacgacgggcuccuggacgucuggacguacaacgcggagcugcucgugcugcuggagaacgagcgcacccucgacuaccacgacuccaacgugaagaaccuguacgagaagguccggagccagcugaagaacaacgccaaggagaucggcaacgggugcuucgaguucuaccacaagugcgacgacacgugcauggaguccgugaagaacggcaccuacgacuaccccaaguacagcgaggaggccaagcucaaccgcgaggagaucgacggcgugaagcuggaguccacccggaucuaccagauccuggccaucuacagcaccgucgccuccagccucgugcugcuggugucccucggggcgaucagcuucuggaugugcagcaacggcucccugcagugccgcaucugcaucuga

SEQ ID NO: 71099 - RNA, 1701 nt, Artificial Sequence
  derived and/or modified sequence opt1 from hemagglutinin__InfluenzaA__AGN69278
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggaccgccacaacgggaagcucugcaagcugcggggcgucgcgccccugcaccucgggaagugcaacaucgccggcuggcugcuggggaacccggagugcgagcuccuguucaccgccagcuccuggagcuacaucguggagacguccaacagcgacaacgggaccugcuaccccggcgacuucaucaacuacgaggagcugcgcgagcagcucuccagcguguccagcuucgagcgguucgagaucuuccccaaggccuccagcuggcccaaccacgagccgaaccgcggcgucaccgccgccugccccuacgccggcgcgaacuccuucuaccggaaccugaucuggcuggugaagaaggggaacagcuaccccaagcucuccaagagcuacaucaacaacaaggagaaggaggugcugguccuguggggcauccaccacccgcccaccuccacggaccagcagagccucuaccagaacgccgacgccuacguguucgugggguccagcaaguacaacaagaaguucaagcccgagaucgccacccgccccaagguccggggccaggccggccgcaugaacuacuacuggacccugguggagcccggggacaccaucacguucgaggcgaccggcaaccugguggucccgcgguacgccuucgccaugaagcgcgggagcggcuccggcaucaucaucagcgacacccccgugcacgacugcaacaccacgugccagacccccaagggggccaucaacaccucccuccccuuccagaacauccacccggugaccaucggcgagugccccaaguacgucaagagcacgaagcugcggauggccaccgggcugcgcaacauccccuccauccagagccggggccucuucggggcgaucgccggcuucaucgagggcggguggaccggcaugaucgacgggugguacggcuaccaccaccagaacgagcagggguccggcuacgccgccgaccgcaagagcacccagaacgccaucgacggcaucacgaacaaggugaacuccgugaucgagaagaugaacacccaguucaccgcggucgggaaggaguucaaccaccuggagaagcggaucgagaaccugaacaagaagguggacgacggccuccuggacgucuggaccuacaacgccgagcugcucgugcugcuggagaacgagcgcacgcucgacuaccacgacagcaacgugaagaaccuguacgagaagguccggucccagcugaagaacaacgccaaggagaucgggaacggcugcuucgaguucuaccacaagugcgacgacacgugcauggagagcgugaagaacgggaccuacgacuaccccaaguacuccgaggaggccaagcucaaccgcgaggagaucgacggcgugaagcuggagagcacccggaucuaccagauccuggccaucuacuccaccgucgcgagcucccucgugcugcuggugagccucggcgccaucuccuucuggaugugcagcaacgggagccugcagugccgcaucugcaucuga

SEQ ID NO: 71100 - RNA, 1701 nt, Artificial Sequence
  derived and/or modified sequence opt1 from hemagglutinin__InfluenzaA__AGN69302
auggaggccaagcuguucguccucuucugcgccuucaccgcgcugaaggccgacaccaucugcgugggcuaccacgccaacaacagcacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacagcugguccuacaucaucgagaccagcaacuccaaggacggcgcgugcuaccccggcgaguucgccgacuacgaggagcugaaggagcagcugagcaccgucuccagcuucgagcgcuucgagaucuuccccaaggccacguccuggcccaaccacgacaccacccgggggaccacgguggccugcagccacuccggcgcgaacagcuucuaccgcaaccuccuguggaucgugaagaaggggaacuccuacccgaagcugagcaaguccuacaccaacaacaagggcaaggagguccucgugaucuggggcgugcaccacccgcccaccgacagcgaccagcagacccuguaccagaacaaccacacguacgucuccguggggagcagcaaguacuacaagcgguucacccccgagaucguggcccgccccaagguccgggagcaggccggccgcaugaacuacuacuggacccugcucgaccagggggacaccaucacguucgaggccaccggcaaccugaucgcccccuggcacgcguucgcccugaagaagggguccagcuccggcaucaugaugagcgacgcccaggugcacaacugcaccaccaagugccagacgccccacggcgcccucaaggggaaccugcccuuccagaacgugcacccggucaccaucggcgagugccccaaguacgugaaguccacccagcugcggauggccaccgggcuccgcaacauccccagcauccagucccggggccuguucggggcgaucgccggcuucaucgagggcggguggacgggcaugguggacgggugguacggcuaccaccaccagaacgagcaggggagcggcuacgccgccgaccagaaguccacccagaucgccaucgacggcaucagcaacaaggucaacuccgugaucgagaagaugaacauccaguucaccagcguggggaaggaguucaacucccuggagaagcgcauggagaaccucaacaagaaggucgacgacggcuuccuggacguguggaccuacaacgcggagcugcucauccugcuggagaacgagcggacgcucgacuuccacgaccugaacgucaagaaccuguacgagaaggucaagagccagcuccgcaacaacgccaaggagaucgggaacggcugcuucgaguucuaccacaagugcgacaacgagugcauggaguccgugaagaacgggaccuacaacuaccccaaguacagcgaggaguccaagcugaaccgggaggagaucgacggcgugaagcuggagagcaugggcauccaccagauccucgccaucuacuccaccguggccagcagccuggugcugcucgucucccugggggccaucagcuucuggaugugcuccaacggcagccugcagugccgcgugugcaucuga

SEQ ID NO: 71101 - RNA, 1701 nt, Artificial Sequence; identical to SEQ ID NO: 71100
  derived and/or modified sequence opt1 from hemagglutinin__InfluenzaA__AGN69314

SEQ ID NO: 71102 - RNA, 1701 nt, Artificial Sequence; identical to SEQ ID NO: 71100
  derived and/or modified sequence opt1 from hemagglutinin__InfluenzaA__AGN69326

SEQ ID NO: 71103 - RNA, 1701 nt, Artificial Sequence
  derived and/or modified sequence opt1 from hemagglutinin__InfluenzaA__AGN69338
auggaggccaagcuguucguccucuucugcgccuucaccgcgcugaaggccgacaccaucugcgugggcuaccacgccaacaacagcacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacagcugguccuacaucaucgagaccagcaacuccaagaacggcgcgugcuaccccggcgaguucgccgacuacgaggagcugaaggagcagcugagcaccgucuccagcuucgagcgcuucgagaucuuccccaaggccacguccuggcccaaccacgacaccacccgggggaccacgguggccugcagccacuccggcgcgaacagcuucuaccgcaaccuccuguggaucgugaagaaggggaacuccuacccgaagcugagcaaguccuacaccaacaacaagggcaaggagguccucgugaucuggggcgugcaccacccgcccaccgacagcgaccagcagacccuguaccagaacaaccacacguacgucuccguggggagcagcaaguacuacaagcgguucacccccgagaucguggcccgccccaagguccgggagcaggccggccgcaugaacuacuacuggacccugcuccaccagggggacaccaucacguucgaggccaccggcaaccugaucgcccccuggcacgcguucgcccugaacgagggguccagcuccggcaucaugcggagcgacgcccaggugcacaacugcaccaccaagugccagacgccccacggcgcccucaaggggaaccugcccuuccagaacgugcacccggucaccaucggcgagugccccaaguacgugaaguccacccagcugcgcauggccaccgggcuccggaacauccccagcauccagucccgcggccuguucggggcgaucgccggcuucaucgagggcggguggacgggcaugguggacgggugguacggcuaccaccaccggaacgagcaggggagcggcuacgccgccgaccagaaguccacccagaucgccaucgacggcaucagcaacaaggucaacuccgugaucgagaagaugaacauccaguucaccagcguggggaaggagugcaacucccuggagaagcgcauggagaaccucaacaagaaggucgacgacggcuuccuggacguguggaccuacaacgcggagcugcucauccugcuggagaacgagcggacgcucgacuuccacgaccugaacgucaagaaccuguacgagaaggucaagagccagcuccgcaacaacgccaaggagaucgggaacggcugcuucgaguucuaccacaagugcgacaacgagugcauggaguccgugaagaacgggaccuacaacuaccccaaguacagcgaggaguccaagcugaaccgggaggagaucgacggcgugaagcuggagagcaugggcauccaccagauccucgccaucuacuccaccguggccagcagccuggugcugcucgucucccugggggccaucagcuucuggaugugcuccaacggcagccugcagugccgcgugugcaucuga

SEQ ID NO: 71104 - RNA, 1701 nt, Artificial Sequence
  derived and/or modified sequence opt1 from hemagglutinin__InfluenzaA__AGO00265
augaaggcccgccugcucgugcugcugugcgccaucgcggccaccgacgccgacaccaucugcaucggcuaccacgccaacaacagcacggacaccgucgacaccauccucgagaagaacgugaccgugacgcacuccgucaaccugcuggaggacagccacaacgggaagcucugccggcugaagggcaucgcgccccugcagcucgggaagugcaacaucgccggcuggauccuggggaacccggagugcgagucccugcucagcgagcgcuccuggagcuacaucguggagacccccaacuccgagaacgggaccugcuaccccggcgacuucaucgacuacgaggagcugcgggagcagcugagcuccgugaccagcuucgagcgcuucgagaucuuccccaaggagacguccuggccgaagcacaacaccaccaagggggucaccgccgccugcagccacgccggcaagugcuccuucuaccggaaccuccuguggcugacggagaaggacgggagcuaccccaaccucaacaacuccuacgugaacaagaagggcaaggaggugcugguccuguggggcgugcaccaccccagcaacaucaaggaccagcagacccucuaccagaaggagaacgcguacguguccgucgugagcuccaacuacaaccgccgguucacccccgagaucgccgagcgcccgaaggugcggggccaggccggccgcaugaacuacuacuggacccugcuggagcccggggacacgaucaucuucgaggccaacggcaaccucaucgcccccugguacgcguucgcccugagccggggguucggcagcggcaucaucaccuccaacgccagcaugcacgagugcaacaccaagugccagacgccccagggggccaucaacuccagccugccguuccagaacauccaccccgucaccaucggcgagugccccaaguacgugcgcuccaccaagcuccggauggugaccgggcugcgcaacauccccagcauccagucccggggccuguucggggccaucgcgggcuucaucgagggcggguggaccggcaugaucgacgggugguacggcuaccaccaccagaacgagcaggggagcggcuacgccgccgaccagaaguccacgcagaacgccaucaacggcaucaccaacaaggucaacagcgugaucgagaagaugaacacccaguucaccgccguggggaaggaguucaacaaccucgagaagcgcauggagaaccugaacaagaaggucgacgacggcuuccuggacaucuggacguacaacgcggagcuccuggugcugcucgagaacgagcggacccuggacuuccacgacuccaacgugaagaaccuguacgagaaggucaagagccagcuccgcaacaacgccaaggagaucgggaacggcugcuucgaguucuaccacaagugcaacaacgagugcauggaguccgugaagaacgggaccuacgacuacccgaaguacagcgaggaguccaagcugaaccgggagaagaucgacggcgucaagcuggagagcaugggcguguaccagauccucgccaucuacuccaccguggccagcucccugguccugcucgugagccugggggccaucagcuucuggaugugcuccaacggcagccugcagugccgcaucugcaucuga

SEQ ID NO: 71105 - RNA, 1701 nt, Artificial Sequence
  derived and/or modified sequence opt1 from hemagglutinin__InfluenzaA__AGO00277
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagagccuccuguccaagcggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaaccacaacaucaacaucggcgugaccgccgccugcagccacgcgggcaaguccagcuucuacaagaaccugcuguggcucacggagaaggacggguccuaccccaaccugaacaagagcuacgucaacaagaaggagaaggaggugcuggugcucuggggcguccaccaccccuccaacaucgagaaccagaagacccuguaccggaaggagaacgccuacgugagcguggucagcuccaacuacaaccgccgguucacccccgagaucgccgagcgcccgaaggugcgggggcaggccggccgcaugaacuacuacuggacccugcucgagcccggcgacacgaucaucuucgaggccaacgggaaccugaucgcgcccugguacgccuucgcccugagccggggccucggguccggcaucaucaccagcaacgccuccauggacgagugcgacaccaagugccagacgccccagggcgccaucaacagcucccugccguuccagaacauccaccccuucaccaucggggagugccccaaguacgugcgcagcaccaagcugcggauggucaccggccuccgcaacauccccuccauccagagccgggggcuguucggcgcgaucgccggguucaucgagggcggcugggccgggaugaucgacggcugguacggguaccaccaccagaacgagcagggcuccggguacgccgccgaccagaaguccacccagaacgcgaucaacggcaucacgaacaaggugaacagcgugaucgagaagaugaacacccaguucaccgccgucggcaaggaguucaacaagcuggagaagcgcauggagaaccucaacaagaagguggacgacggguuccuggacaucuggaccuacaacgccgagcugcucgugcugcuggagaacgagcggacgcucgacuuccacgacagcaacgucaagaaccuguacgagaaggugaagaaccagcugcgcaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggggucaagcuggagagcaugggcguguaccagauccuggccaucuacuccaccgucgcgagcagccucgugcugcuggugucccucggcgccaucagcuucuggaugugcuccaacgggagccugcagugccgcaucugcaucuga

SEQ ID NO: 71106 - RNA, 1701 nt, Artificial Sequence; identical to SEQ ID NO: 62642
  derived and/or modified sequence opt1 from hemagglutinin__InfluenzaA__AGO00289

SEQ ID NO: 71107 - RNA, 1698 nt, Artificial Sequence
  derived and/or modified sequence opt1 from hemagglutinin__InfluenzaA__AGO00301
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaaggcgccccuccagcuggggaacugcaacaucgccggcugggugcuggggaacccggagugcgagagccuccuguccaaccggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaaccacaccacgcggggcgucaccgccgccugcccccacgcgcgcaagagcuccuucuacaagaaccugguguggcugaccgaggccaacggcagcuaccccaaccucucccggagcuacgugaacaaccaggagaaggagguccuggugcuguggggcgugcaccaccccuccaacaucgaggagcagcgcgcccucuaccggaaggacaacgccuacgucagcguggugagcuccaacuacaaccgccgguucaccccggagaucgccaagcgccccaagguccgggaccagagcgggcgcaugaacuacuacuggacgcugcuggagcccggggacaccaucaucuucgaggcgaccggcaaccucaucgcccccugguacgccuucgcccugucccggggcccggggagcggcaucaucaccuccaacgcgccccuggacgagugcgacacgaagugccagacgccccagggggccaucaacagcucccuccccuuccagaacauccacccggugaccaucggcgagugccccaaguacgugcgcagcaccaagcugcggauggucaccggccugcgcaacauccccuccgugcagagccggggccucuucggggccaucgccggguucaucgagggcggguggaccggcaugauggacggcugguacggguaccaccaccagaacgagcagggcuccggguacgccgccgaccagaaguccacccagaacgcgaucaacggcaucaccaacaaggugaacagcgucaucgagaagaugaacacgcaguucaccgccguggggaaggaguucaacaagcuggagaagcgcauggagaaccugaacaagaagguggacgacggcuucauggacaucuggaccuacaacgccgagcuccugguccugcucgagaacgagcggacccuggacuuccacgacagcaacgugaagaaccuguacgagaaggucaagaaccagcuccgcaacaacgccaaggagcugggcaacgggugcuucgaguucuaccacaagugcgacaacgagugcauggaguccgugaagaacggcacguacgacuaccccaaguacagcgaggaguccaagcugaaccgcgagaagaucgacggggugaagcucgagagcaugggcgucuaccggauccuggccaucuacuccaccguggcgagcagccuggugcuccuggucucccugggggccaucagcuucuggaugugcuccaacggcagccuccagugccgcaucugcaucuga

SEQ ID NO: 71108 - RNA, 1701 nt, Artificial Sequence
  derived and/or modified sequence opt1 from hemagglutinin__InfluenzaA__AGO00313
augaagaccaucaucgcccugagcuacaucuucugccaggugcucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagaacgggggcagcuacgccugcaagcgcgggcccgacaacuccuucuucagccggcugaacuggcucuacaaguccgagagcaccuaccccgugcugaacgucacgaugcccaacaacgacaacuucgacaagcuguacaucuggggcgugcaccacccguccaccgacaaggagcagaccaaccucuacgugcaggccagcggccgcgucaccguguccacgaagcggagccagcagaccaucauccccaacguggggagccgccccuggguccggggccuguccagcgggaucuccaucuacuggaccaucgugaagcccggcgacauccugcucaucaacagcaacggcaaccugaucgcgccgcgcggguacuucaagauccggaccggcaaguccagcaucaugcgcuccgacgcccccaucgggacgugcagcuccgagugcaucacccccaacggcagcauccccaacgacaagccguuccagaacgugaacaagaucaccuacggggccugccccaaguacgucaagcagaacacccugaagcucgccacgggcaugcggaacgugcccgagaagcagacccgcggcaucuucggggccaucgcgggcuucaucgagaacgggugggagggcaugaucgacgggugguacggcuuccggcaccagaacuccgagggcaccgggcaggccgccgaccucaagagcacccaggccgccaucgaccagaucaacggcaagcugaaccgcgugaucgagaagacgaacgagaaguuccaccagaucgagaaggaguucuccgaggucgaggggcggauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcgccggcagcugcgcgagaacgccgaggacaugggcaacgggugcuucaagaucuaccacaagugcgacaacgccugcaucggcagcauccggaacggcaccuacgaccacgacgucuaccgcgacgaggcccugaacaaccgcuuccagaucaaggggguggagcucaaguccggcuacaaggacuggauccuguggaucagcuucgcgaucuccugcuuccugcucugcgucgugcugcugggguucaucaugugggccugccagaagggcaacauccggugcaacaucugcaucuga

SEQ ID NO: 71109 - RNA, 1704 nt, Artificial Sequence; identical to SEQ ID NO: 70105
  derived and/or modified sequence opt1 from hemagglutinin__InfluenzaA__AGO00325

SEQ ID NO: 71110 - RNA, 1698 nt, Artificial Sequence
  derived and/or modified sequence opt1 from hemagglutinin__InfluenzaA__AGO00337
augaaggccaaccugcucgugcugcugagcgcccucgcggccgccgacgccgacaccaucugcaucggcuaccacgccaacaacuccaccgacacggucgacaccgugcuggagaagaacgugaccgucacccacagcgugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacagcgagaacggcaucugcuacccgggcgacuucaucgacuacgaggagcuccgcgagcagcuguccagcguguccagcuucgagcgguucgagaucuuccccaaggaguccagcuggcccaaccacaacaccaacggggugaccgccgccugcucccacgagggcaagagcuccuucuaccgcaaccugcucuggcugaccgagaaggaggggagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucggguccggcaucaucacgagcaacgccuccaugcacgagugcaacaccaagugccagacgccccugggcgccaucaacagcucccugcccuaccagaacgugcacccggugaccaucggggagugccccaaguacguccggagcgccaagcuccgcauggugaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgucaucgagaagaugaacauccaguucaccgcggugggcaaggaguucaacaagcucgagaagcggauggagaaccugaacaagaagguggacgacggguuccuggacaucuggaccuacaacgccgagcuccugguccugcucgagaacgagcgcacgcuggacuuccacgacagcaacgugaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacagcgaggaguccaagcugaaccgcgagaagguggacggggucaagcuggagagcaugggcaucuaccagauccucgccaucuacuccaccguggccagcucccuggugcugcucgucagccugggcgcgaucagcuucuggaugugcuccaacgggagccugcagugccggaucugcaucuga

SEQ ID NO: 71111 - RNA, 1698 nt, Artificial Sequence; identical to SEQ ID NO: 64286
  derived and/or modified sequence opt1 from hemagglutinin__InfluenzaA__AGO00349

SEQ ID NO: 71112 - RNA, 1698 nt, Artificial Sequence
  derived and/or modified sequence opt1 from hemagglutinin__InfluenzaA__AGO00373
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccgaccacaacaccaacggggugaccgccgccugcagccacgagggcaaguccagcuucuaccgcaaccugcucuggcugaccgagaaggaguccagcuaccccaagcugaagaacuccuacgucaacaagaaggggaaggaggugcucgugcuguggggcauccaccacccgcccaacagcaaggagcagcagaaccuguaccagaacgagaacgcguacgucuccguggugacgagcaacuacaaccggcgcuucacccccgagaucgccgagcggcccaagguccgcgaccaggccgggcggaugaacuacuacuggacccuccugaagccgggcgacaccaucaucuucgaggccaacggcaaccugaucgcccccauguacgcguucgcccucagccgcggguucggcuccgggaucaucacgagcaacgccuccaugcacgagugcaacaccaagugccagacgccccugggcgccaucaacagcucccugcccuaccagaacauccacccggugaccaucggcgagugccccaaguacgugcggagcgccaagcuccgcauggucaccgggcugcggaacauccccuccauccagagccgcggccuguucggggcgaucgccggcuucaucgagggcggguggaccggcaugaucgacgggugguacggcuaccaccaccagaacgagcagggguccggcuacgccgccgaccagaaguccacccagaacgccaucaacgggaucaccaacaaggugaacacggugaucgagaagaugaacauccaguucaccgcggucggcaaggaguucaacaagcucgagaagcggauggagaaccugaacaagaagguggacgacggcuuccuggacaucuggaccuacaacgccgagcuccuggugcugcucgagaacgagcgcacccuggacuuccacgacagcaacaugaagaaccuguacgagaaggucaagagccagcucaagaacaacgccaaggagaucgggaacggcugcuucgaguucuaccacaagugcgacaacgagugcauggaguccgugcggaacgggacguacgacuaccccaaguacagcgaggaguccaagcugaaccgcgagaaggucgacggcgugaagcuggagagcauggggaucuaccagauccucgccaucuacuccaccguggccagcucccugguccugcucgugagccugggcgcgaucagcuucuggaugugcuccaacggcagccugcagugccggaucugcaucuga

SEQ ID NO: 71113 - RNA, 1698 nt, Artificial Sequence
  derived and/or modified sequence opt1 from hemagglutinin__InfluenzaA__AGO00385
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucgagaucuuccccaaggagagcuccuggcccgaccacaacaccaacggcgugaccgccgccugcagccacgaggggaaguccagcuucuaccggaaccugcucuggcugaccgagaaggaguccagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccgccgguucacccccgagaucgccgagcgccccaagguccgggaccaggccggccgcaugaacuacuacuggacccuccugaagccgggcgacaccaucaucuucgaggccaacgggaaccugaucgcccccauguacgcguucgcccucagccggggcuucggguccggcaucaucacgagcaacgccuccaugcacgagugcaacaccaagugccagacgccccugggcgccaucaacagcucccugcccuaccagaacauccacccggugaccaucggggagugccccaaguacgugcgcagcgccaagcuccggauggucaccggccugcgcaacauccccuccauccagagccgggggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcgcaacggcacguacgacuaccccaaguacagcgaggaguccaagcugaaccgggagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccgcaucugcaucuga

SEQ ID NO: 71114 - RNA, 1698 nt, Artificial Sequence
  derived and/or modified sequence opt1 from hemagglutinin__InfluenzaA__AGO00397
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucgagaucuuccccaaggagagcuccuggcccgaccacaacaccaacggcgugaccgccgccugcagccacgaggggaaguccagcuucuaccggaaccugcucuggcugaccgagaaggaguccagcuaccccaagcugaagaacuccuacgucaacaagaagggcaaggaggugcucgugcugugggggauccaccacccgcccaacagcaaggagcagcagaaccuguaccagaacgagaacgcguacgucuccguggugacgagcaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucggguccggcaucaucacgagcaacgccuccaugcacgagugcaacaccaagugccagacgccccugggcgccaucaacagcucccugcccuaccagaacauccacccggugaccaucggggagugccccaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 71115 - RNA, 1698 nt, Artificial Sequence
  derived and/or modified sequence opt1 from hemagglutinin__InfluenzaA__AGO00409
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucgagaucuuccccaaggagagcuccuggcccgaccacaacaccaacggcgugaccgccgccugcagccacgaggggaagaacuccuucuaccggaaccugcucuggcugaccgagaagaaguccagcuaccccgagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71116 - RNA, 1698 nt, Artificial Sequence
  derived and/or modified sequence opt1 from hemagglutinin__InfluenzaA__AGO00421
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggagcuacaucgucgagacgcccaacuccgagaacgggaucugcuacccgggcgacuucaucgacuacgaggagcuccgcgagcagcugagcuccgugagcuccuucgagcgguucaagaucuuccccaaggagagcuccuggcccgaccacaacaccaccggggugaccgccgccugcagccacgagggcaagaacuccuucuaccgcaaccugcucuggcugacgaagaaggagagcuccuaccccgagcugaagaacagcuacgucaacaagaagcggaaggaggugcucgugcugugggggauccaccacccgcccaacuccaaggagcagcagaaccuguaccagaacgagaacgcguacgucagcguggugaccuccaacuacaaccgccgguucacccccgagaucgccgagcgccccaaggucaagggccaggccggccggaugaacuacuacuggacccuccugaagccgggggacacgaucaucuucgaggccaacggcaaccugaucgcccccauguacgcguucgcccucagccgcggguucggcagcggcaucaucaccuccaacgccagcaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccagcauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucacgaacaaggugaacaccgugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacgcuggacuuccacgacagcaacgucaagaaccuguacgagaaggugaagucccagcucaagaacaacgccaaggagaucgggaacggcugcuucgaguucuaccacaagugcgacaacgagugcauggagagcguccggaacgggaccuacgacuaccccaaguacuccgaggagagcaagcugaaccgcgagaagguggacggcgugaagcuggaguccaugggcaucuaccagauccucgccaucuacagcaccgucgccuccagccuggugcugcucgugucccugggggcgaucagcuucuggaugugcagcaacggcucccugcagugccggaucugcaucuga

SEQ ID NO: 71117 - RNA, 1698 nt, Artificial Sequence
  derived and/or modified sequence opt1 from hemagglutinin__InfluenzaA__AGO00433
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcuggagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71118 - RNA, 1698 nt, Artificial Sequence
  derived and/or modified sequence opt1 from hemagglutinin__InfluenzaA__AGO00445
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccacgcugaagaacagcuacgucaacaagaagggcaaggaggugcucgugcugugggggauccaccacccgcccaacuccaaggagcagcagaaccuguaccagaacgagaacgcguacgucagcguggugaccuccaacuacaaccggcgcuucacccccgagaucgccgagcggcccaagguccgcgaccaggccggccggaugaacuacuacuggacccuccugaagccgggcgacacgaucaucuucgaggccaacgggaaccugaucgcccccauguacgcguucgcccucagccgcggcuucgggagcggcaucaucaccuccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcaccuacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71119 - RNA, 1701 nt, Artificial Sequence
  derived and/or modified sequence opt1 from hemagglutinin__InfluenzaA__AGO02696
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcuggugaagaagggcaacuccuaccccaagcucagcaucuccuacaucaacgacaaggggaaggaggugcugguccuguggggcauccaccaccccagcaccacggccgaccagcagagccucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgcggccuccagccugguccugguggugucccucggcgccaucagcuucuggaugugcagcaacggcucccugcagugccggaucugcaucuga

SEQ ID NO: 71120 - RNA, 1701 nt, Artificial Sequence; identical to SEQ ID NO: 71048
  derived and/or modified sequence opt1 from hemagglutinin__InfluenzaA__AGO02697

SEQ ID NO: 71121 - RNA, 1701 nt, Artificial Sequence; identical to SEQ ID NO: 70866
  derived and/or modified sequence opt1 from hemagglutinin__InfluenzaA__AGO02698

SEQ ID NO: 71122 - RNA, 1701 nt, Artificial Sequence; identical to SEQ ID NO: 70866
  derived and/or modified sequence opt1 from hemagglutinin__InfluenzaA__AGO02699

SEQ ID NO: 71123 - RNA, 1701 nt, Artificial Sequence
  derived and/or modified sequence opt1 from hemagglutinin__InfluenzaA__AGO02700
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuacccccgcuacuccgaggaggcgaagcucaaccgggaggagaucgacggcaucaagcuggagagcacccgcaucuaccagauccuggccaucuacuccaccguggccagcagccucguccugaucgugucccugggggccaucagcuucuggaugugcuccaacggcagccuccagugccggaucugcaucuga

SEQ ID NO: 71124 - RNA, 1701 nt, Artificial Sequence
  derived and/or modified sequence opt1 from hemagglutinin__InfluenzaA__AGO02701
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagccacuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagcaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacggccaggggagcggcuacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggguuccuggacaucuggaccuacaacgccgagcugcucgugcugcuggagaacgagcgcacccucgacuaccacgacuccaacgugaagaaccuguacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggcgaucuacagcaccgucgccuccagccucgugcugguggucagccugggcgccaucuccuucuggaugugcagcaacggcucccuccagugccgcaucugcaucuga

SEQ ID NO: 71125 - RNA, 1683 nt, Artificial Sequence; identical to SEQ ID NO: 70996
  derived and/or modified sequence opt1 from hemagglutinin__InfluenzaA__AGO51374

SEQ ID NO: 71126 - RNA, 1701 nt, Artificial Sequence
  derived and/or modified sequence opt1 from hemagglutinin__InfluenzaA__AGO86686
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucucccggcucaacuggcugcaccagcuggagaaccgcuaccccgcccucaacgugaccaugcccaacaacgacaaguucgacaagcuguacaucuggggcgugcaccaccccagcacggacuccgaccagaucagcgucuacgcccaggccagcgggcgggugaccguguccaccaagcgcagccagcagaccgucaucccgaacaucgggucccggcccugggugcgcggcaucagcucccggaucagcaucuacuggacgaucgugaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagcggacccgcaagcagcugcgcgagaacgccgaggacaugggcaacgggugcuucaagaccuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 71127 - RNA, 1701 nt, Artificial Sequence; identical to SEQ ID NO: 71048
  derived and/or modified sequence opt1 from hemagglutinin__InfluenzaA__AGQ16240

SEQ ID NO: 71128 - RNA, 1701 nt, Artificial Sequence; identical to SEQ ID NO: 71048
  derived and/or modified sequence opt1 from hemagglutinin__InfluenzaA__AGQ16241

SEQ ID NO: 71129 - RNA, 1701 nt, Artificial Sequence
  derived and/or modified sequence opt1 from hemagglutinin__InfluenzaA__AGQ16242
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaccagcuacaucaacgacaagggcaaggagauccuggugcucugggggauccaccaccccagcacgaccgccgaccagcagucccuguaccagaacgccgacgccuacgucuucgugggcaccagccgguacuccaagaaguucaagcccgagaucgccauccgcccgaaggugcgggaccaggagggccgcaugaacuacuacuggacccuggucgagcccggggacaagaucacguucgaggcgaccggcaaccucguggugccccgguacgccuucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucacgaacaaggugaacagcgugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 71130 - RNA, 1701 nt, Artificial Sequence; identical to SEQ ID NO: 71068
  derived and/or modified sequence opt1 from hemagglutinin__InfluenzaA__AGQ16243

SEQ ID NO: 71131 - RNA, 1701 nt, Artificial Sequence
  derived and/or modified sequence opt1 from hemagglutinin__InfluenzaA__AGQ16245
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 71132 - RNA, 1701 nt, Artificial Sequence; identical to SEQ ID NO: 71068
  derived and/or modified sequence opt1 from hemagglutinin__InfluenzaA__AGQ16247

SEQ ID NO: 71133 - RNA, 1701 nt, Artificial Sequence
  derived and/or modified sequence opt1 from hemagglutinin__InfluenzaA__AGQ16248
augcaggccauccuggugguccuccuguacaccuucgccaccgcgacggccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucaacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcugucccagagcuacaucaacgacaagggcaaggaggugcugguccucugggggauccaccaccccagcacgaccgccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccauccacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacgcagaacgccaucgacaagaucaccaacaaggugaacagcgugaucgagaagaugaacacccaguucaccgcggucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 71134 - RNA, 1701 nt, Artificial Sequence; identical to SEQ ID NO: 70866
  derived and/or modified sequence opt1 from hemagglutinin__InfluenzaA__AGQ16329

SEQ ID NO: 71135 - RNA, 1701 nt, Artificial Sequence; identical to SEQ ID NO: 70891
  derived and/or modified sequence opt1 from hemagglutinin__InfluenzaA__AGQ16331

SEQ ID NO: 71136 - RNA, 1701 nt, Artificial Sequence; identical to SEQ ID NO: 70866
  derived and/or modified sequence opt1 from hemagglutinin__InfluenzaA__AGQ16332

SEQ ID NO: 71137 - RNA, 1701 nt, Artificial Sequence; identical to SEQ ID NO: 70866
  derived and/or modified sequence opt1 from hemagglutinin__InfluenzaA__AGQ16333

SEQ ID NO: 71138 - RNA, 1701 nt, Artificial Sequence
  derived and/or modified sequence opt1 from hemagglutinin__InfluenzaA__AGQ16335
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccaggugcucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcagagcuccgggcgcaucaccgugagcaccaagcggagccagcaggccgucaucccgaacaucggcucccgcccccggauccgcaacauccccagccggaucuccaucuacuggacgaucgugaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgucaagcagaacacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 71139 - RNA, 1701 nt, Artificial Sequence
  derived and/or modified sequence opt1 from hemagglutinin__InfluenzaA__AGQ16336
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaaccgguccuucuucagccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcagccagcaggccgugaucccgaacaucggcagccggccccgcauccggaacauccccucccgcaucagcaucuacuggacgaucgucaagcccggcgacauccugcucaucaacuccaccgggaaccugaucgccccgcggggcuacuucaagauccgcagcgggaaguccagcaucaugcgguccgacgcccccaucggcaagugcaagagcgagugcaucacccccaacggcuccauccccaacgacaagccguuccagaacgugaaccgcaucaccuacggggccugcccccgguacgugaagcagagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 71140 - RNA, 1701 nt, Artificial Sequence; identical to SEQ ID NO: 71138
  derived and/or modified sequence opt1 from hemagglutinin__InfluenzaA__AGQ16337

SEQ ID NO: 71141 - RNA, 1701 nt, Artificial Sequence; identical to SEQ ID NO: 70876
  derived and/or modified sequence opt1 from hemagglutinin__InfluenzaA__AGQ16338

SEQ ID NO: 71142 - RNA, 1701 nt, Artificial Sequence
  derived and/or modified sequence opt1 from hemagglutinin__InfluenzaA__AGQ16339
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaagaacuggauccuguggaucuccuucgccaucagcugcuuccugcugugcgucgcccugcucggguucaucaugugggcgugccagaagggcaacauccggugcaacaucugcaucuga

SEQ ID NO: 71143 - RNA, 1701 nt, Artificial Sequence; identical to SEQ ID NO: 71002
  derived and/or modified sequence opt1 from hemagglutinin__InfluenzaA__AGQ16340

SEQ ID NO: 71144 - RNA, 1701 nt, Artificial Sequence; identical to SEQ ID NO: 70866
  derived and/or modified sequence opt1 from hemagglutinin__InfluenzaA__AGQ16341

SEQ ID NO: 71145 - RNA, 1701 nt, Artificial Sequence; identical to SEQ ID NO: 70876
  derived and/or modified sequence opt1 from hemagglutinin__InfluenzaA__AGQ16342

SEQ ID NO: 71146 - RNA, 1701 nt, Artificial Sequence
  derived and/or modified sequence opt1 from hemagglutinin__InfluenzaA__AGQ16343
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccgggacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71147 - RNA, 1701 nt, Artificial Sequence; identical to SEQ ID NO: 70876
  derived and/or modified sequence opt1 from hemagglutinin__InfluenzaA__AGQ16344

SEQ ID NO: 71148 - RNA, 1701 nt, Artificial Sequence; identical to SEQ ID NO: 70866
  derived and/or modified sequence opt1 from hemagglutinin__InfluenzaA__AGQ16345

SEQ ID NO: 71149 - RNA, 1701 nt, Artificial Sequence
  derived and/or modified sequence opt1 from hemagglutinin__InfluenzaA__AGQ16346
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugccgguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 71150 - RNA, 1701 nt, Artificial Sequence; identical to SEQ ID NO: 70866
  derived and/or modified sequence opt1 from hemagglutinin__InfluenzaA__AGQ16347

SEQ ID NO: 71151 - RNA, 1701 nt, Artificial Sequence; identical to SEQ ID NO: 71002
  derived and/or modified sequence opt1 from hemagglutinin__InfluenzaA__AGQ16348

SEQ ID NO: 71152 - RNA, 1701 nt, Artificial Sequence; identical to SEQ ID NO: 70866
  derived and/or modified sequence opt1 from hemagglutinin__InfluenzaA__AGQ16349

SEQ ID NO: 71153 - RNA, 1701 nt, Artificial Sequence
  derived and/or modified sequence opt1 from hemagglutinin__InfluenzaA__AGQ16350
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucauguggaccugccagaaggggaacauccgcugcaacaucugcaucuga

SEQ ID NO: 71154 - RNA, 1701 nt, Artificial Sequence
  derived and/or modified sequence opt1 from hemagglutinin__InfluenzaA__AGQ47719
augaaggccauccugcucgugcugcugugcaccuucaccgccacgaacgcggacacccucugcaucggcuaccacgccaacaacagcaccgacaccgucgacacggugcuggagaagaacgugaccgucacccacuccgugaaccugcucgaggaccgccacaacgggaagcugugcaagcugggcgggaucgcgccccuccaccugggcaagugcaacaucgccggguggcugcucggcaacccggagugcgagcugcuguucaccgugagcuccuggagcuacaucgucgagacguccaacagcgacaacgggaccugcuaccccggcgacuucaucaacuacgaggagcuccgggagcagcuguccagcguguccagcuucgagcgcuucgagaucuuccccaagaccuccagcuggcccgaccacgagaccaaccggggcgugacggccgccugcccguacgccggggccaacuccuucuaccgcaaccugaucuggcucgucaagaagggcaacagcuaccccaagcuguccaagagcuacgugaacaacaaggggaaggaggugcugguccucuggggcauccaccacccgcccaccuccaccgaccagcagagccuguaccagaacgccgacgcguacguguucgugggcuccagcaaguacaaccggaaguucaagcccgagaucgccgcccgccccaagguccgggggcaggccggccgcaugaacuacuacuggacccugaucgagcccggggacacgaucaccuucgaggccaccggcaaccucguggugccccgguacgcguucgccaugaaccgcggcagcggguccggcaucaucaucagcgacgccccgauccacgacugcaacaccaagugccagacgcccaagggggccaucaacaccucccugcccuuccagaacauccaccccgucaccaucggcgagugcccgaaguacgucaagagcaccaagcugcggauggccacggggcuccgcaacauccccuccauccagagccggggccuguucggcgcgaucgccggguucaucgagggcggguggaccggcaugaucgacgggugguacggcuaccaccaccagaacggccagggguccggcuacgccgccgaccagaaguccacccagaacgccaucgacgggaucaccaacaaggugaacagcgugaucgagaagaugaacacgcaguucaccgcggugggcaaggaguucaaccaccuggagaagcgcaucgagaaccucaacaagaagguggacgacggguuccuggacgucuggaccuacaacgccgagcugcucgugcugcuggagaacgagcggacccucgacuuccacgacagcaacgucaagaaccuguacgagaaggugcgcucccagcugcggaacaacgccaaggagaucggcaacggcugcuucgaguucuaccacaagugcgacgacacgugcauggagagcgugaagaacgggaccuacgacuaccccaaguacuccgaggagagcaagcucaaccgcgaggagaucgacggcgucaagcuggaguccacccggaucuaccagauccuggccaucuacagcaccgccgcguccagccucgugcugcuggugucccucggggccaucagcuucuggaugugcagcaacggcucccugcagugccgcaucugcaucuga

SEQ ID NO: 71155 - RNA, 1698 nt, Artificial Sequence; identical to SEQ ID NO: 63123
  derived and/or modified sequence opt1 from hemagglutinin__InfluenzaA__AGQ47728

SEQ ID NO: 71156 - RNA, 1701 nt, Artificial Sequence
  derived and/or modified sequence opt1 from hemagglutinin__InfluenzaA__AGQ47740
augaaggcccgccugcucgugcugcugugcgcccucgcggccaccgacgccgacaccaucugcaucggcuaccacgccaacaacagcacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggagcugguccuacaucguggagacccccaacagcgagaacggcgccugcuaccccggcgacuucaucgacuacgaggagcugcgcgagcagcuguccagcguguccagccucgagcgguucgagaucuucccgaaggaguccagcuggcccaaccacaacaccaucaagggggucaccgccuccugcagccaccgcggccaguccagcuucuaccggaaccugcuguggcucacgaagaagggggacuccuaccccaagcugaacaacagcuacgugaacaacaagggcaaggaggugcugguccucuggggcgugcaccaccccuccagcagcaacgagcagcagucccuguaccgcaacgagaacgcguacgugagcgucguguccagcaacuacaaccggcgcuucaccccggagaucgccgcccggcccaaggugcgcgaccagaccgggcggaugaacuacuacuggacccugcucgagcccggcgacacgaucauguucgaggccaccgggaaccugaucgcccccugguacgcguucgcccugucccgcggcuucgggagcggcaucaucaccuccaacgccagcaugcacgagugcaacaccaagugccagacgccgcagggcgccaucaacuccagccuccccuuccagaacauccaccccgucaccaucggggagugccccaaguacgugcgguccaccaagcugcgcauggugaccggccugcggaacaucccgagcauccagucccgcggccucuucggggccaucgcgggguucaucgagggcggcuggacggggaugaucgacggcugguacggguaccaccaccagaacgagcagggcagcggguacgccgccgaccagaaguccacccagaacgccaucaacggcaucaccaacaaggucaacagcgugaucgagaagaugaacacccaguucacggccgugggcaaggaguucaacaaccuggagaagcggauggagaaccugaacaagaaggucgacgacggguuccucgacaucuggaccuacaacgcggagcugcuggugcuccuggagaacgagcgcacccuggacuuccacgaccucaacgugaagaaccuguacgagaaggucaagucccagcugaagaacaacgccaaggagaucggcaacgggugcuucgaguucuaccacaagugcgacaacgagugcauggagagcgugcggaacggcaccuacgacuaccccaaguacuccgaggagagcaagcucaaccgcgagaagaucgacggggucaagcuggagagcaugggcguguaccagauccuggccaucuacuccacgguggccagcucccucguccugcuggugagccugggcgccaucuccuucuggaugugcagcaacgggucccuccagugccggaucugcaucuga

SEQ ID NO: 71157 - RNA, 1701 nt, Artificial Sequence
  derived and/or modified sequence opt1 from hemagglutinin__InfluenzaA__AGQ47752
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaaggcgccccuccagcuggggaagugcaacaucgccggcugggugcuggggaacccggagugcgagagccuccuguccaaccggagcugguccuacaucgccgagacccccaacagcgagaacggcaucugcuaccccggcgacuucgccgacuacgaggagcugcgcgagcagcucuccagcguguccagcuucgagcgguucgagaucuuccccaaggagcgcuccuggccgaagcacaacaccauccgcggggucaccgccgccugcagccacgcgggcaaguccagcuucuacaagaaccugguguggcugacggaggccaacggguccuaccccgcccucagcaccuccuacgugaacaaccaggagaaggagguccuggugcuguggggcgugcaccaccccagcaacaucgaggagcagcggacccucuaccggaaggacaacgccuacgucagcgugguguccagcaacuacaaccgccgguucacccccgagaucgccaagcgcccgaagguccgggaccagcccgggcgcaugaacuacuacuggacgcugcuggagcccggcgacaccaucaucuucgaggcgaccggcaaccucaucgcccccugguacgccuucgcccugucccgggggccgggcagcgggaucaucaccuccaacgcccccauggacgagugcgacacgaagugccagacgccccagggcgcgaucaacagcucccugcccuuccagaacauccacccggugaccaucggcgagugccccaaguacgugcgcagcaccaagcuccggauggucaccgggcugcgcaacauccccuccauccagagccggggccuguucggggccaucgccggcuucaucgagggcggguggaccggcaugauggacgggugguacggcuaccaccaccagaacgagcagggguccggcuacgccgccgaccagaaguccacccagaacgcgaucaacgggaucaccaacaaggugaacagcgugaucgagaagaugaacacgcaguucaccgccgucggcaaggaguucaacaagcucgagaagcgcauggagaaccugaacaagaagguggacgacggcuuccuggacaucuggaccuacaacgccgagcuccuggugcugcucgagaacgagcggacccuggacuuccacgacagcaacgucaagaaccuguacgagaaggugaagaaccagcuccgcaacaacgccaaggagcuggggaacggcugcuucgaguucuaccacaagugcgacaacgagugcauggaguccgucaagaacgggacguacgacuaccccaaguacagcgaggaguccaagcugaaccgggagaagaucgacggcgugaagcucgagagcauggggguguaccgcauccuggccaucuacuccaccgucgcgagcagccuggugcuccuggugucccugggcgccaucagcuucuggaugugcuccaacggcagccuccagugccgcaucugcaucuga

SEQ ID NO: 71158 - RNA, 1701 nt, Artificial Sequence
  derived and/or modified sequence opt1 from hemagglutinin__InfluenzaA__AGQ47764
augaaggccaagcugcucauccugcugugcgcccucaccgcgaccgacgccgacacgaucugcaucggcuaccacgccaacaacagcaccgacaccguggacaccguccuggagaagaacgugacggugacccacuccgucaaccugcucgaggacagccacaacgggaagcugugccgccugaagggcaucgcgccccuccagcuggggaagugcaacaucgccggcuggauccuggggaacccggagugcgagucccuccugagcaagcgguccuggagcuacaucgccgagacccccaacuccgagaacggcgccugcuaccccggcgacuucgccgacuacgaggagcugcgcgagcagcucagcuccgugagcuccuucgagcgguucgagaucuuccccaaggagcgcagcuggccgaagcacaacaucacccgcggggugacggccgcgugcucccacgccggcaagagcuccuucuacaagaaccugcuguggcucaccgagaccgacgggagcuaccccaagcuguccaagagcuacgucaacaacaaggagaaggaggugcuggugcucuggggcguccaccaccccuccaacaucgaggaccagaagacccuguaccggaaggagaacgccuacgugagcguggucagcuccaacuacaaccggcgcuucacgcccgagaucgccgagcggccgaaggugcgcgggcaggccggccggaucaacuacuacuggacccugcucgagcccggcgacaccaucaucuucgaggcgaacgggaaccugaucgcccccugguacgccuucgcccugagccgcgacuucggcuccgggaucaucaccagcaacgccuccauggacgagugcgacacgaagugccagacgccccagggcgcgaucaacagcucccucccguuccagaacauccaccccgugaccaucggcgagugccccaaguacgucaagagcaccaagcugcggauggugaccgggcugcgcaacauccccuccauccagagccggggccucuucggggccaucgccggcuucaucgagggcggguggaccggcaugaucgacgggugguacggcuaccaccaccagaacgagcagggguccggcuacgccgccgaccagaaguccacccagaacgcgaucaacgggaucaccaacaaggugaacagcgucaucgagaagaugaacacgcaguucaccgccgugggcaaggaguucaacaagcuggagaagcgcauggagaaccugaacaagaagguggacgacggcuuccucgacaucuggaccuacaacgccgagcugcugguccuccuggagaacgagcggacccuggacuuccacgacagcaacgugaagaaccucuacgagaaggugaagaaccagcugcgcaacaacgccaaggagaucgggaacggcugcuucgaguucuaccacaagugcaacaacgagugcauggaguccgucaagaacgggacguacgacuacccgaaguacagcgaggaguccaagcugaaccgggagaagaucgacggcgugaagcucgagagcaugggggucuaccagauccuggccaucuacuccaccguggcgagcagccuggugcuccuggucucccugggcgccaucagcuucuggaugugcuccaacggcagccuccagugccgcaucugcaucuga

SEQ ID NO: 71159 - RNA, 1701 nt, Artificial Sequence
  derived and/or modified sequence opt1 from hemagglutinin__InfluenzaA__AGQ47776
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagagccuccuguccaagcggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaagcacaacaucaacaucggcgugaccgccgccugcagccacgcgggcaaguccagcuucuacaagaaccugcuguggcucacggagaaggacggguccuaccccaaccugaacaagagcuacgucaacaagaaggagaaggaggugcuggugcucuggggcguccaccaccccuccaacaucgaggaccagaagacccuguaccggaaggagaacgccuacgugagcguggucagcuccaacuacaaccgccgguucacccccgagaucgccgagcgcccgaaggugcgggggcaggccggccgcaugaacuacuacuggacccugcucgagcccggcgacacgaucaucuucgaggccaacgggaaccugaucgcgcccugguacgccuucgcccugagccggggccucggguccggcaucaucaccagcaacgccuccauggacgagugcgacaccaagugccagacgccccagggcgccaucaacagcucccugccguuccagaacauccaccccuucaccaucggggagugccccaaguacgugcgcagcaccaagcugcggauggucaccggccuccgcaacauccccuccauccagagccgggggcuguucggcgcgaucgccggguucaucgagggcggcuggaccgggaugaucgacggcugguacggguaccaccaccagaacgagcagggcuccggguacgccgccgaccagaaguccacgcagaacgccaucaacggcaucaccaacaaggugaacagcgugaucgagaagaugaacacccaguucaccgcggucggcaaggaguucaacaagcuggagaagcgcauggagaaccucaacaagaagguggacgacggguuccuggacaucuggacguacaacgccgagcugcucgugcugcuggagaacgagcggacccucgacuuccacgacagcaacgucaagaaccuguacgagaaggugaagaaccagcugcgcaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggggucaagcuggagagcaugggcguguaccagauccuggccaucuacuccaccgucgccagcagccucgugcugcuggugucccucggcgcgaucagcuucuggaugugcuccaacgggagccugcagugccgcaucugcaucuga

SEQ ID NO: 71160 - RNA, 1701 nt, Artificial Sequence
  derived and/or modified sequence opt1 from hemagglutinin__InfluenzaA__AGQ47788
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagagccucuucuccaagaaguccuggagcuacaucgccgagacccccaacagcgagaacgggaccugcuaccccggcuacuucgccgacuacgaggagcugcgggagcagcuguccagcguguccagcuucgagcgcuucgagaucuuccccaaggagcgguccuggccgaagcacaacgucacccgcggcgugacggccgccugcagccacaagggcaaguccagcuucuaccggaaccuccuguggcugaccgagaaggacggguccuaccccaaccucagcaaguccuacgugaacaacaaggagaaggagguccuggugcuguggggcgugcaccaccccagcaacaucgaggaccagaagacccucuaccgcaaggagaacgcguacgucagcgugguguccagcaacuacaaccggcgcuucacccccgagaucgccgagcggccgaagguccgcgggcaggccggccggaucaacuacuacuggacgcugcuggagcccggcgacaccaucaucuucgaggccaacgggaaccucaucgcccccuggcacgcguucgcccugucccgcggcuucgggagcggcaucaucaccuccaacgccagcauggacgagugcgacaccaagugccagacgccccagggcgccaucaacuccagccugccguuccagaacauccaccccgugaccaucggggagugccccaaguacgugcgguccaccaagcuccgcauggucaccggccugcggaacauccccagcauccagucccgcgggcuguucggcgccaucgcgggguucaucgagggcggcuggacggggaugaucgacggcugguacggguaccaccaccagaacgagcagggcagcggguacgccgccgaccagaaguccacccagaacgccaucaacggcaucaccaacaaggugaacagcgugaucgagaagaugaacacccaguucacggccgucggcaaggaguucaacaagcucgagaagcggauggagaaccugaacaagaagguggacgacggguuccuggacaucuggaccuacaacgcggagcuccuggugcugcucgagaacgagcgcacccuggacuuccacgacuccaacgucaagaaccuguacgagaaggucaagagccagcucaagaacaacgccaaggagaucggcaacgggugcuucgaguucuaccacaagugcaacaacgagugcauggaguccgugaagaacggcaccuacgacuacccgaaguacagcgaggaguccaagcugaaccgggagaagaucgacggggugaagcuggagagcaugggcguguaccagauccucgccaucuacagcacggucgccuccagccuggugcugcucgugucccugggcgccaucagcuucuggaugugcuccaacgggagccugcagugccgcaucugcaucuga

SEQ ID NO: 71161 - RNA, 1701 nt, Artificial Sequence
  derived and/or modified sequence opt1 from hemagglutinin__InfluenzaA__AGQ47800
augaaggcccgccugcucgugcugcugugcgcccucgcggccaccgacgccgacaccaucugcaucggcuaccacgccaacaacagcacggacaccgucgacaccauccuggagaagaacgugaccgugacgcacuccgucaaccugcucgaggacagccacaacgggaagcugugccggcugaagggcaucgcgccccuccagcuggggaagugcaacaucgccggcuggauccuggggaacccggagugcgagucccuccugagcgagcgcuccuggagcuacaucguggagauccccaacuccgagaacgggaccugcuaccccggcgacuucaccgacuacgaggagcugcgggagcagcucagcuccgugagcuccuucgagcgcuucgagaucuuccccaaggagagcuccuggccgaagcacaacaccgcccgcggggucacggccgccugcagccacgcgggcaaguccagcuucuaccggaaccugcuguggcucaccgagaaggacggguccuaccccaaccugaagaacagcuacgugaacaagaagggcaaggaggugcugguccucuggggcgugcaccaccccuccagcaucaaggagcagcagacccuguaccagaaggagaacgccuacgugagcgucguguccagcaacuacaaccggcgcuucacccccgagaucgccgagcggccgaaggugcgcgaccaggccggccggaugaacuacuacuggacgcugcucgagcccggcgacaccaucaucuucgaggccaacgggaaccugaucgcgcccugguacgccuucgcccugucccgcggcuucgggagcggcaucaucaccuccaacgccagcaugcacgagugcgacaccaagugccagacgccccagggcgccaucaacuccagccucccguuccagaacauccaccccgucaccaucggggagugccccaaguacgugcgguccaccaagcugcgcauggugaccggccugcggaacauccccagcauccagucccgcggccucuucggggcgaucgccggguucaucgagggcggcuggacggggaugaucgacggcugguacggguaccaccaccagaacgagcagggcagcggguacgccgccgaccagaaguccacccagaacgccaucaacggcaucaccaacaaggucaacagcgugaucgagaagaugaacacccaguucacggcggugggcaaggaguucaacaaccuggagaagcggauggagaaccugaacaagaaggucgacgacggguuccucgacaucuggaccuacaacgccgagcugcugauccuccuggagaacgagcgcacccuggacuuccacgacuccaacgugaagaaccucuacgagaaggucaagagccagcugcggaacaacgccaaggagaucggcaacgggugcuucgaguucuaccacaagugcaacaacgagugcauggaguccgugaagaacggcaccuacgacuacccgaaguacagcgaggaguccaagcugaaccgcgagaagaucgacggggugaagcucgagagcaugggcgucuaccagauccuggccaucuacagcacgguggccuccagccuggugcuccuggucucccugggcgcgaucagcuucuggaugugcuccaacgggagccuccagugccggaucugcaucuga

SEQ ID NO: 71162 - RNA, 1701 nt, Artificial Sequence
  derived and/or modified sequence opt1 from hemagglutinin__InfluenzaA__AGQ47811
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagagccucuucuccaagaaguccuggagcuacaucgccgagacccccaacagcgagaacgggaccugcuaccccggcuucuucgccgacuacgaggagcugcgggagcagcuguccagcguguccagcuucgagcgcuucgagaucuuccccaaggagcgguccuggccgaagcacaacgucacccgcggcgugacggccgccugcagccacaagggcaaguccagcuucuaccggaaccuccuguggcugaccgagaagaacggguccuaccccaaccucagcaaguccuacgugaacaacaaggagaaggagguccuggugcuguggggcgugcaccaccccagcaacaucgaggaccagaagaccaucuaccgcaaggagaacgcguacgucagcgugguguccagcaacuacaaccggcgcuucacccccgagaucgccgagcggccgaagguccgcgggcaggccggccggaucaacuacuacuggacgcuccuggagcccggcgacaccaucaucuucgaggccaacgggaaccugaucgcccccuggcacgcguucgcccucucccgcggcuucgggagcggcaucaucaccuccaacgccagcauggacgagugcgacaccaagugccagacgccccagggcgccaucaacuccagccugccguuccagaacauccaccccgugaccaucggggagugccccaaguacgugcgguccaccaagcugcgcauggucaccggccuccggaacauccccagcauccagucccgcgggcuguucggcgccaucgcgggguucaucgagggcggcuggacggggaugaucgacggcugguacggguaccaccaccagaacgagcagggcagcggguacgccgccgaccagaaguccacccagaacgccaucgacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgcggagcugcucgugcugcuggagaacgagcgcacccucgacuuccacgacuccaacgucaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggggugaagcuggagagcaugggcguguaccagauccuggccaucuacagcacggucgccuccagccucgugcugcuggugucccucggcgccaucagcuucuggaugugcuccaacgggagccugcagugccgcaucugcaucuga

SEQ ID NO: 71163 - RNA, 1701 nt, Artificial Sequence
  derived and/or modified sequence opt1 from hemagglutinin__InfluenzaA__AGQ47823
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccgaagugcgagagccuguucuccaaggagagcugguccuacaucgccgagacccccaaccccgagaacgggaccugcuaccccggcuacuucgccgacuacgaggagcuccgggagcagcugagcuccgucagcuccuucgagcgcuucgagaucuucccgaaggagagcuccuggcccaaccacacggugaccaagggcgugaccaccagcugcucccacaacggcaagagcuccuucuaccggaaccugcucuggcugacggagaagaacgggcuguaccccaaccucagcaaguccuacgucaacaacaaggagaaggaggugcuggugcuguggggcguccaccaccccagcaacauccgcgaccagcgggccaucuaccacaccgagaacgccuacgugagcguggucuccagccacuacucccgccgguucaccccggagaucgcgaagcgccccaaggugcgggggcaggagggccgcaucaacuacuacuggacccuccuggagcccggcgacacgaucaucuucgaggccaacgggaaccugaucgcccccugguacgccuucgcccucagccggggcuucggguccggcaucaucaccagcaacgcguccauggacgagugcgacgccaagugccagaccccgcagggcgccaucaacagcucccugcccuuccagaacgugcaccccgucaccaucggggagugccccaaguacgugcgcagcacgaagcugcggauggugaccggccuccgcaacaucccguccauccagagccgggggcuguucggcgccaucgccggguucaucgagggcggcuggaccgggaugaucgacggcugguacggguaccaccaccagaacgagcagggcuccggguacgcggccgaccagaaguccacccagaacgccaucaacggcaucacgaacaaggucaacagcgugaucgagaagaugaacacccaguucaccgccgugggcaaggaguucaacaagcuggagcgccggauggagaaccucaacaagaaggucgacgacggguuccuggacaucuggaccuacaacgccgagcugcucgugcugcuggagaacggccgcacgcucgacuuccacgacagcaacgucaagaaccuguacgagaaggugaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccggggcaagaucgacggcgucaagcuggagagcauggggguguaccagauccuggccaucuacuccaccguggccagcucccucguccugcuggugagccucggcgccaucuccuucuggaugugcagcaacgggucccugcagugccgcaucugcaucuga

SEQ ID NO: 71164 - RNA, 1701 nt, Artificial Sequence
  derived and/or modified sequence opt1 from hemagglutinin__InfluenzaA__AGQ47835
augaagaccaucaucgcccugagcuacaucuucugccucgugcugggccaggacuuccccgggaacgacaacuccaccgccacgcugugccucggccaccacgcggucccgaacgggaccaucgugaagaccaucaccaacgaccagaucgaggugacgaacgccaccgagcugguccagagcuccagcaccggcaagaucugcaacaacccccaccgcauccuggacgggaucaacugcacccucaucgacgcccugcugggcgacccccacugcgacggcuuccagaacgagacgugggaccucuucguggagcgguccaaggccuucagcaacugcuaccccuacuacgugccggacuacgccucccugcgcagccuggucgcguccagcgggacccucgaguucaucaacgagggcuucaacuggaccggggugacccagaacggcggguccaacgccugcaagcggggccccaacagcggcuucuucucccgccugaacuggcuguacaagagcgggacgaccuaccccgugcucaacgucaccaugcccaacaacgacaacuucgacaagcuguacaucuggggcgugcaccacccguccaccgaccaggagcagacgaaccuguacgugcaggccagcgggcgggucaccguguccaccaagcgcagccagcagaccaucacgcccaacaucggcucccggcccugggugcgcggccucagcagccggaucuccaucuacuggaccaucgucaagcccggggacauccuggugaucaacagcaacggcaaccugaucgccccgcgcggguacuucaagaugcggaccggcaaguccagcaucaugcgcuccgacgcgcccaucgggaccugcaucagcgagugcaucacgcccaacggcuccauccccaacgacaagccguuccagaacgugaacaagaucaccuacggcgccugccccaaguacgucaagcagaacacccucaagcuggccaccgggaugcggaacgugcccgagaagcagacgcgcggcaucuucggggccaucgccggcuucaucgagaacgggugggagggcaugguggacggcugguacggguuccggcaccagaacagcgagggcaccgggcaggcggccgaccugaaguccacccaggccgccaucgaccagaucaacggcaagcucaaccgcgucaucgagaagaccaacgagaaguuccaccagaucgagaaggaguucagcgagguggaggggcggauccaggaccuggagaaguacguggaggacacgaagaucgaccugugguccuacaacgccgagcuccuggucgcgcuggagaaccagcacaccaucgaccucaccgacagcgagaugaacaagcuguucgagaagacccgccggcagcugcgcgagaacgccgaggacaugggcaacggcugcuucaagaucuaccacaagugcgacaacgccugcaucggguccauccggaacggcacguacgaccacgacguguaccgcgacgaggcccucaacaaccgcuuccagaucaagggggucgagcucaagagcggcuacaaggacuggauccuguggaucuccuucgccaucagcugcuuccugcugugcguggugcugcucggcuucaucaugugggcgugccagaaggggaacauccggugcaacaucugcaucuga

SEQ ID NO: 71165 - RNA, 1701 nt, Artificial Sequence
  derived and/or modified sequence opt1 from hemagglutinin__InfluenzaA__AGQ47847
augaaggcccgccugcucauccugcugugcgcccucgcggccaccgacgccgacaccaucugcaucggcuaccacgccaacaacagcacggacaccguggacaccguccuggagaagaacgugaccgugacgcacuccgucaaccugcucgaggacagccacaacgggaagcugugccggcugaagggcaucgcgccccuccagcuggggaagugcaacaucgccggcuggcugcucgggaacccggagugcgacucccugcugcccgccagcuccuggagcuacaucguggagacccccaacuccaagaacggcaucugcuaccccggcgacuucaucgacuacgaggagcuccgcgagcagcugagcuccgugagcuccuucgagcgguucgagaucuucccgaaggagagcuccuggcccaagcacaacaccaccaagggggucacggccgccugcagccacgcgggcaaguccagcuucuaccgcaaccugcucuggcugaccaagaaggaggacuccuaccccaagcugagcaacuccuacgugaacaagaaggggaaggaggugcucguccuguggggcgugcaccaccccagcaacagcaaggagcagcagacccuguaccagaacgagaacgccuacguguccgucgugagcuccaacuacaaccggcgcuucaccccggagaucgccgagcggcccaaggugcgcgaccaggccgggcggaugaacuacuacuggacgcuccuggagcccggcgacaccaucaucuucgaggccaacggcaaccugaucgcgcccugguacgccuucgcccucagccgcggguucggcuccgggaucaucaccagcaacgccuccaugcacgagugcaacaccaagugccagacgccgcagggcgccaucaacagcucccugcccuuccagaacauccaccccgucaccaucggcgagugccccaaguacgucaagagcgcgaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgccgccgaccagaaguccacgcagaacgcgaucaacgggaucaccaacaaggugaacagcgugaucgagaagaugaacacccaguucaccgccgugggcaaggaguucaacaaccuggagaagcgcauggagaaccucaacaagaaggucgacgacggcuuccuggacaucuggacguacaacgccgagcugcucgugcugcuggagaacgagcggacccucgacuuccacgacagcaacgugaagaaccuguacgagaaggucaagauccagcugaagaacaacgccaaggagaucgggaacggcugcuucgaguucuaccacaagugcgacaacgagugcauggaguccgugcgcaacgggaccuacgacuaccccaaguacagcaaggaguccaagcucaaccgggagaagaucgacggcgucaagcuggagcccauggggguguaccagauccuggccaucuacagcaccguggcgagcucccucguccugcuggugagccucggcgccaucuccuucuggaugugcagcaacggcucccugcagugccgcaucugcaucuga

SEQ ID NO: 71166 - RNA, 1701 nt, Artificial Sequence
  derived and/or modified sequence opt1 from hemagglutinin__InfluenzaA__AGQ47870
augaaggccauccugcucgugcugcugugcaccuucgccgcgaccaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcugcucaccgugagcuccuggagcuacaucgucgagaccuccaacagcgacaacggcacgugcuaccccggggacuucaucaacuacgaggagcugcgggagcagcuguccagcguguccagcuucgagcgcuucgagaucuuccccaagaccuccagcuggcccaaccacgagaccaaccggggcgugaccgccgccugcccguacgccggggccaacuccuucuaccgcaaccucaucuggcuggucaagaagggcaacagcuaccccaagcuguccaagagcuacgugaacaacaaggggaaggaggugcucguccuguggggcauccaccacccgcccacguccaccgaccagcagagccuguaccagaacgcggacgccuacguguucgugggcuccagcaaguacaaccggaaguucaagcccgagaucgccgcccgccccaagguccgggggcaggccggccgcaugaacuacuacuggacccucaucgagcccggggacaccaucacguucgaggcgaccggcaaccugguggugccccgguacgccuucgccaugaaccgcggcagcggguccggcaucaucaucagcgacgccccgguccacgacugcaacaccaagugccagacccccaagggggccaucaacacgucccugcccuuccagaacauccaccccgugaccaucggcgagugcccgaaguacgucaagagcaccaagcuccggauggcgaccgggcugcgcaacauccccuccauccagagccggggccuguucggcgccaucgccggguucaucgagggcggguggacgggcaugaucgacgggugguacggcuaccaccaccagaacgagcagggcuccggguacgccgccgaccagcgcagcacccagaacgcgaucgacggcaucaccaacaaggugaacuccgugaucgagaagaugaacacccaguucacggccguggggaaggaguucaaccaccucgagaagcggaucgagaaccugaacaagaaggucgacgacggcuuccuggacaucuggaccuacaacgccgagcuccuggugcugcucgagaacgagcgcacccuggacuuccacgacagcaacgucaagaaccuguacgagaaggugcggucccagcuccgcaacaacgccaaggagaucgggaacggcugcuucgaguucuaccacaagugcgacgacacgugcauggagagcgugaagaacggcaccuacgacuaccccaaguacuccgaggagagcaagcugaaccgggaggagaucgacggggucaagcuggaguccacccgcaucuaccagauccucgccaucuacagcaccguggcguccagccuggugcugcucgucucccugggcgccaucagcuucuggaugugcagcaacgggucccugcagugccggaucugcaucuga

SEQ ID NO: 71167 - RNA, 1701 nt, Artificial Sequence
  derived and/or modified sequence opt1 from hemagglutinin__InfluenzaA__AGQ47882
augaaggccauccugcucgugcugcugugcaccuucgccgcgaccaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcugcucaccgugagcuccuggagcuacaucgucgagaccuccaacagcgacaacggcacgugcuaccccggggacuucaucaacuacgaggagcugcgggagcagcuguccagcguguccagcuucgagcgcuucgagaucuuccccaagaccuccagcuggcccaaccacgagaccaaccggggcgugaccgccgccugcccguacgccggggccaacuccuucuaccgcaaccucaucuggcuggucaagaaggagaacagcuaccccaagcuguccaagagcuacgugaacaacaagggcaaggaggugcucguccugugggggauccaccacccgcccacguccaccgaccagcagagccuguaccagaacgcggacgccuacguguucgugggcuccagcaaguacaaccggaaguucaagcccgagaucgccgcccgccccaagguccggggccaggccgggcgcaugaacuacuacuggacccucaucgagcccggcgacaccaucacguucgaggcgaccgggaaccugguggugccccgguacgccuucgccaugaaccgcggcagcggcuccgggaucaucaucagcgacgccccgguccacgacugcaacaccaagugccagacccccaagggcgccaucaacacgucccugcccuuccagaacauccaccccgugaccaucggggagugcccgaaguacgucaagagcaccaagcuccggauggcgaccggccugcgcaacauccccuccauccagagccgggggcuguucggcgccaucgccggcuucaucgagggcggguggacggggaugaucgacggcugguacggguaccaccaccagaacgagcagggcuccggcuacgccgccgaccagcgcagcacccagaacgcgaucgacgggaucaccaacaaggugaacuccgugaucgagaagaugaacacccaguucacggccgugggcaaggaguucaaccaccucgagaagcggaucgagaaccugaacaagaaggucgacgacggguuccuggacaucuggaccuacaacgccgagcuccuggugcugcucgagaacgagcgcacccuggacuuccacgacagcaacgucaagaaccuguacgagaaggugcggucccagcuccgcaacaacgccaaggagaucggcaacgggugcuucgaguucuaccacaagugcgacgacacgugcauggagagcgugaagaacggcaccuacgacuaccccaaguacuccgaggagagcaagcugaaccgggaggagaucgacggcgucaagcuggaguccacccgcaucuaccagauccucgccaucuacagcaccguggcguccagccuggugcugcucgucucccugggggccaucagcuucuggaugugcagcaacggcucccugcagugccggaucugcaucuga

SEQ ID NO: 71168 - RNA, 1701 nt, Artificial Sequence; identical to SEQ ID NO: 70103
  derived and/or modified sequence opt1 from hemagglutinin__InfluenzaA__AGQ47894

SEQ ID NO: 71169 - RNA, 1701 nt, Artificial Sequence
  derived and/or modified sequence opt1 from hemagglutinin__InfluenzaA__AGQ47906
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcauccaccacccgagcaccaaccaggagcagaccucccuguacgugcaggccagcgggcgggugaccgucuccacgcgccggagccagcagaccaucauccccaacaucggcagccgccccugggugcggggccuguccagccgcaucuccaucuacuggaccaucgugaagcccggggacguccucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagagcggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 71170 - RNA, 1701 nt, Artificial Sequence
  derived and/or modified sequence opt1 from hemagglutinin__InfluenzaA__AGQ47918
augaagaccaucaucgcccugagcuacaucuucugccucgcccugggccaggaccugcccgggaacgacaacaacaccgcgacgcucugccugggccaccacgccgugccgaacgggacccuggucaagaccaucaccgacgaccagaucgaggugacgaacgccaccgagcucgugcaguccagcuccaccggcaagaucugcaacaacccccaccgcauccuggacgggaucgacugcacccugaucgacgcccuccugggcgacccccacugcgacgucuuccagaacgagacgugggaccuguucguggagcggagcaaggccuucuccaacugcuaccccuacgacgugccggacuacgcgagccuccgcucccuggucgccagcuccggcacccuggaguucaucaccgagggguucaccuggacgggcgugacccagaacgggggcagcaacgccugcaagcgggggcccggcuccggcuucuucagccgccucaacuggcugaccaaguccgggagcaccuaccccgugcugaacgucacgaugcccaacaacgacaacuucgacaagcucuacaucuggggcgugcaccacccguccaccaaccaggagcagaccagccuguacgugcaggccuccgggcgggucaccgugagcacgcgccggucccagcagaccaucauccccaacaucggcagccgccccugggugcggggccugagcucccgcaucagcaucuacuggaccaucgucaagcccggggacgugcucgugaucaacuccaacggcaaccugaucgcgccgcggggguacuucaagaugcgcaccggcaagagcuccaucaugcggagcgacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 71171 - RNA, 1701 nt, Artificial Sequence
  derived and/or modified sequence opt1 from hemagglutinin__InfluenzaA__AGQ47930
augaaggccaaccugcucgugcugcugugcgcccucgcggccgccgacgccgacaccaucugcaucggcuaccacgccaacaacagcaccgacacggucgacaccgcgcuggagaagaacgugaccgugacccacuccgucaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucguggagacgcccaacuccgagaacggcaucugcuacccgggcgacuucaucgacuacgaggagcuccgcgagcagcugagcuccgucagcuccuucgagcgguucgagaucuuccccaaggagagcuccuggcccaaccacaacaccaacaagggggugaccgccgccugcagccacgccggcaaguccagcuucuaccgcaaccugcucuggcugaccgagaaggagggguccuaccccaagcugaagaacagcuacgugaacaagaagggcaaggagguccucgugcugugggggauccaccacccguccaacagcaaggaccagcagaaccuguaccagaacgagaacgccuacguguccgucgugacgagcaacuacaaccggcgcuucacccccgagaucgccgagcggcccaaggugcgcgaccaggccggccggaugaacuacuacuggacccuccugaagcccggcgacaccaucaucuucgaggcgaacgggaaccugaucgccccgauguacgccuucgcccucagccgcggcuucggguccggcaucaucacgagcaacgccuccaugcacgagugcaacaccaagugccagacgccccugggcgcgaucaacagcucccugcccuuccagaacauccaccccgucaccaucggggagugcccgaaguacgugcggagcgccaagcuccgcauggugaccggccugcggaacauccccuccauccagagccgcgggcuguucggcgccaucgccggguucaucgagggcggcuggaccgggaugaucgacggcugguacggguaccaccaccagaacgagcagggcuccggguacgccgcggaccagaaguccacccagaacgccaucaacggcaucaccaacaaggucaacagcgugaucgagaagaugaacauccaguucacggccgugggcaaggaguucaacaagcucgagaagcggauggagaaccugaacaagaaggucgacgacggguuccuggacaucuggaccuacaacgccgagcuccuggugcugcucgagaacgagcgcacccuggacuuccacgacagcaacgugaagaaccuguacgagaaggucaagucccagcucaagaacaacgccaaggagaucggcaacgggugcuucgaguucuaccacaagugcgacaacgagugcauggagagcgugcggaacggcaccuacgacuaccccaaguacuccgaggagagcaagcugaaccgcgagaaggucgacggggugaagcuggaguccaugggcaucuaccagauccucgcgaucuacagcacgguggccuccagccugguccugcucgugagccugggcgccaucuccuucuggaugugcagcaacgggucccugcagugccggaucugcaucuga

SEQ ID NO: 71172 - RNA, 1698 nt, Artificial Sequence; identical to SEQ ID NO: 64286
  derived and/or modified sequence opt1 from hemagglutinin__InfluenzaA__AGQ47942

SEQ ID NO: 71173 - RNA, 1698 nt, Artificial Sequence
  derived and/or modified sequence opt1 from hemagglutinin__InfluenzaA__AGQ47954
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccggaacgagaacgcguacgucagcguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgcccccauguacgcguucgcccucagccggggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgcuccgccaagcuccggauggucaccggccugcgcaacauccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccgcaucugcaucuga

SEQ ID NO: 71174 - RNA, 1698 nt, Artificial Sequence
  derived and/or modified sequence opt1 from hemagglutinin__InfluenzaA__AGQ47966
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucgagaucuuccccaaggagagcuccuggcccgaccacaacaccaacggcgugaccgccgccugcagccacgaggggaagaacuccuucuaccggaaccugcucuggcugaccgagaaggagagcuccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71175 - RNA, 1698 nt, Artificial Sequence
  derived and/or modified sequence opt1 from hemagglutinin__InfluenzaA__AGQ47978
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucgagaucuuccccaaggagagcuccuggcccgaccacaacaccaacggcgugaccgccgccugcagccacgaggggaagaacuccuucuaccggaaccugcucuggcugaccaagaaggagagcuccuaccccgagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71176 - RNA, 1698 nt, Artificial Sequence
  derived and/or modified sequence opt1 from hemagglutinin__InfluenzaA__AGQ47990
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucaagaucuuccccaaggagagcuccuggcccgaccacaacaccaacggcgugaccgccgccugcagccacgaggggaagaacuccuucuaccggaaccugcucuggcugaccaagaaggagagcuccuaccccgagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71177 - RNA, 1698 nt, Artificial Sequence
  derived and/or modified sequence opt1 from hemagglutinin__InfluenzaA__AGQ48002
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggagcuacaucgucgagacgcccaacuccgagaacggcaucugcuacccgggggacuucaucgacuacgaggagcuccgggagcagcugagcuccgugagcuccuucgagcgcuucaagaucuuccccaaggagagcuccuggcccgaccacaacaccaacggcgugaccgccgccugcagccacgaggggaagaacuccuucuaccggaaccugcucuggcugaccaagaaggagagcuccuaccccgagcugaagaacagcuacgucaacaagaagcgcaaggaggugcucgugcuguggggcauccaccacccgcccaacuccaaggagcagcagaaccuguaccagaacgagaacgcguacgucagcguggugacguccaacuacaaccggcgcuucacccccgagaucgccgagcggcccaaggucaaggaccaggccgggcgcaugaacuacuacuggacccuccugaagccgggcgacaccaucaucuucgaggccaacggcaaccugaucgcccccauguacgcguucgcccucagccggggguucggcagcgggaucaucacguccaacgccagcaugcacgagugcaacaccaagugccagacgccccugggcgccaucaacuccagccugcccuaccagaacauccacccggugaccaucggcgagugccccaaguacgugcgcuccgccaagcuccggauggucaccgggcugcgcaacauccccagcauccagucccggggccuguucggggcgaucgccggcuucaucgagggcggguggaccggcaugaucgacgggugguacggcuaccaccaccagaacgagcaggggagcggcuacgccgccgaccagaaguccacccagaacgccaucaacgggaucaccaacaaggugaacacggugaucgagaagaugaacauccaguucaccgcggucggcaaggaguucaacaagcucgagaagcgcauggagaaccugaacaagaagguggacgacggcuuccuggacaucuggaccuacaacgccgagcuccuggugcugcucgagaacgagcggacccuggacuuccacgacagcaacgucaagaaccuguacgagaaggugaagucccagcucaagaacaacgccaaggagaucgggaacggcugcuucgaguucuaccacaagugcgacaacgagugcauggagagcguccgcaacgggacguacgacuaccccaaguacuccgaggagagcaagcugaaccgggagaagguggacggcgugaagcuggaguccauggggaucuaccagauccucgccaucuacagcaccgucgccuccagccuggugcugcucgugucccugggcgcgaucagcuucuggaugugcagcaacggcucccugcagugccgcaucugcaucuga

SEQ ID NO: 71178 - RNA, 1698 nt, Artificial Sequence
  derived and/or modified sequence opt1 from hemagglutinin__InfluenzaA__AGQ48014
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccgggcugcgacccccugcugcccgugggcuccuggagcuacaucgucgagacgcccaacuccgagaacgggaucugcuacccgggcgacuucaucgacuacgaggagcuccgggagcagcugagcuccgugagcuccuucgagcgcuucaagaucuuccccaaggagagcuccuggcccgaccacaacaccaacggggugaccgccgccugcagccacgagggcaagaacuccuucuaccggaaccugcucuggcugaccaagaaggagagcuccuaccccgagcugaagaacagcuacgucaacaagaagcgcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaaggucaaggaccaggccggccgcaugaacuacuacuggacccuccugaagccgggcgacaccaucaucuucgaggccaacgggaaccugaucgcccccauguacgcguucgcccucagccggggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgcuccgccaagcuccggauggucaccggccugcgcaacauccccagcauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagagcaagcugaaccgggagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccgcaucugcaucuga

SEQ ID NO: 71179 - RNA, 1698 nt, Artificial Sequence
  derived and/or modified sequence opt1 from hemagglutinin__InfluenzaA__AGQ48026
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggagcuacaucgucgagacgcccaacuccgagaacgggaucugcuacccgggcgacuucaucgacuacgaggagcuccgcgagcagcugagcuccgugagcuccuucgagcgguucaagaucuuccccaaggagagcuccuggcccgaccacaacaccaacggggugaccgccgccugcagccacgagggcaagaacuccuucuaccgcaaccugcucuggcugaccaagaaggagagcuccuaccccgagcugaagaacagcuacgucaacaagaagcggaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 71180 - RNA, 1698 nt, Artificial Sequence
  derived and/or modified sequence opt1 from hemagglutinin__InfluenzaA__AGQ48038
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggagcuacaucgucgagacgcccaacuccgagaacgggaucugcuacccgggcgacuucaucgacuacgaggagcuccgcgagcagcugagcuccgugagcuccuucgagcgguucaagaucuuccccaaggagagcuccuggcccgaccacaacaccaacggggugaccgccgccugcagccacgagggcaagaacuccuucuaccgcaaccugcucuggcugaccaagaaggagagcuccuaccccgagcugaagaacagcuacgucaacaagaagcgggaggaggugcucgugcugugggggauccaccacccgcccaacuccgaggagcagcagaaccuguaccagaacgagaacgcguacgucagcguggugacguccaacuacaaccgccgguucacccccgagaucgccgagcgccccaaggucaagggccaggccggccggaugaacuacuacuggacccuccugaagccgggggacaccaucaucuucgaggccaacggcaaccugaucgcccccauguacgcguucgcccucagccgcggguucggcagcggcaucaucacguccaacgccagcaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccagcauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacacggugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucgggaacggcugcuucgaguucuaccacaagugcgacaacgagugcauggagagcguccggaacgggacguacgacuaccccaaguacuccgaggagagcaagcugaaccgcgagaagguggacggcgugaagcuggaguccaugggcaucuaccagauccucgccaucuacagcaccgucgccuccagccuggugcugcucgugucccugggggcgaucagcuucuggaugugcagcaacggcucccugcagugccggaucugcaucuga

SEQ ID NO: 71181 - RNA, 1698 nt, Artificial Sequence
  derived and/or modified sequence opt1 from hemagglutinin__InfluenzaA__AGQ48050
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggagcuacaucgucgagacgcccaacuccgagaacgggaucugcuacccgggcgacuucaucgacuacgaggagcuccgcgagcagcugagcuccgugagcuccuucgagcgguucaagaucuuccccaaggagagcuccuggcccgaccacaacaccaacggggugaccgccgccugcagccacgagggcaagaacuccuucuaccgcaaccugcucuggcugaccaagaaggagagcuccuaccccgagcugaagaacagcuacgucaacaagaagcgggaggaggugcucgugcugugggggauccaccacccgcccgacuccgaggagcagcagaaccuguaccagaacgagaacgcguacgucagcguggugacguccaacuacaaccgccgguucacccccgagaucgccgagcgccccaaggucaagggccaggccggccggaugaacuacuacuggacccuccugaagccgggggacaccaucaucuucaaggccaacggcaaccugaucgcccccauguacgcguucgcccucagccgcggguucggcagcggcaucaucacguccaacgccagcaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccagcauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacacggugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucgggaacggcugcuucgaguucuaccacaagugcgacaacgagugcauggagagcguccggaacgggacguacgacuaccccaaguacuccgaggagagcaagcugaaccgcgagaagguggacggcgugaagcuggaguccaugggcaucuaccagauccucgccaucuacagcaccgucgccuccagccuggugcugcucgugucccugggggcgaucagcuucuggaugugcagcaacggcucccugcagugccggaucugcaucuga

SEQ ID NO: 71182 - RNA, 1689 nt, Artificial Sequence
  derived and/or modified sequence opt1 from hemagglutinin__InfluenzaA__AGQ80946
auggccaucaucuaccugauccuccuguucaccgccgugcgcggcgaccagaucugcaucggguaccacagcaacaacuccaccgagaaggucgacacgauccuggagcggaacgugaccgugacccacgcgcaggacauccucgagaagacccacaacggcaagcugugcaagcugaacgggaucccgccccucgagcugggcgacugcagcaucgccggguggcugcucggcaaccccgagugcgaccgccugcugacgguccccgagugguccuacaucauggagaaggagaacccccggaacggccucugcuacccggggagcuucaacgacuacgaggagcugaagcaccuccuguccagcgugacccacuucgagaaggugaagauccugcccaaggaccgcuggacccagcacaccacgaccggcgggucccgggccugcgccgucagcggcaaccccuccuucuuccgcaacaugguguggcugaccaagaaggggcccaacuacccgguggccaagggcagcuacaacaacaccuccggcgaccagaugcucaucaucuggggcguccaccaccccaacgacgaggcggagcagcggacgcuguaccagaacguggggaccuacgugagcgucgggaccuccacccugaacaagcgcagcgugcccgagaucgccacgcggcccaaggugaacggccagggcgggcgcauggaguucuccuggaccauccucgacguccuggacaccaucaacuucgagagcaccggcaaccugaucgccccggaguacggguucaagaucuccaagcggggcagcuccgggaucaugaagacggagggcacccucgagaacugcgagaccaagugccagacgccccugggcgccaucaacaccacccugcccuuccacaacauccacccccucaccaucggggagugcccgaaguacgucaagagcgagcgccuggugcuggcgaccggccuccggaacgugccccagaucgagagccgcgggcuguucggcgccaucgccggguucaucgagggcggcuggcaggggaugguggacggcugguacggguaccaccacuccaacgaccagggcagcggguacgccgccgacaaggaguccacgcagaaggcgaucgacggcaucaccaacaaggugaacagcgucaucgagaagaugaacacccaguucgaggccgugggcaaggaguucuccaaccuggagaagcggcucgagaaccugaacaagaagauggaggacggguuccuggacguguggaccuacaacgccgagcuccugguccugauggagaacgagcgcacgcucgacuuccacgacagcaacgugaagaaccuguacgacaagguccggaugcagcugcgcgacaacgccaaggagcucggcaacgggugcuucgaguucuaccacaagugcgacgacgagugcaugaacuccgugaagaacggcaccuacgacuaccccaaguacgaggaggagagcaagcugaaccggaacgagaucaagggcgugaagcuguccaacaugggggucuaccagauccucgccaucuacgcgaccguggccggcagccugucccuggccaucaugaucgccgggaucagccucuggaugugcuccaacggcagccugcagugccgcaucugcaucuga

SEQ ID NO: 71183 - RNA, 1689 nt, Artificial Sequence
  derived and/or modified sequence opt1 from hemagglutinin__InfluenzaA__AGQ80947
auggccaucaucuaccugauccuccuguucgccaccgugcgcggcgaccagaucugcaucggguaccacagcaacaacuccaccgagaaggucgacacgauccuggagcggaacaucaccgugacccacgcgcaggacauccucgagaagacccacaacggcaagcugugcaagcugaacgggaucccgccccucgagcugggcaacugcagcaucgccggguggcugcucggcaaccccgagugcgaccgccugcugacggugcccgagugguccuacaucauggagaaggagaacccccgggacggccucugcuacccggggagcuucaacgacuacgaggagcugaagcaccuccuguccagcgucacccacuucgagaaggugaagauccugcccaaggaccgcuggacccagcacaccacgaccggcgggucccgggccugcgccgugagcggcaaccccuccuucuuccgcaacauggucuggcugaccaagaaggggagcaacuaccccaucgccaagggcuccuacaacaacaccagcggcgagcagaugcucaucaucuggggcgugcaccacccgaacgacgacgcggagcagcggacgcuguaccagaacguggggaccuacgucuccguggggaccagcacccugaacaagcgcuccauccccgagaucgccacgcggcccaaggugaacggccagggcgggcgcauggaguucagcuggaccauccucgacaugcuggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacauccacccccucaccaucggggagugccccaaguacgucaagagcgagcgccuggugcuggcgaccggccuccggaacgugccgcagaucgagucccgcgggcuguucggcgccaucgccggguucaucgagggcggcuggcaggggauggucgacggcugguacggguaccaccacagcaacgaccagggcuccggguacgccgccgacaaggagagcacgcagaaggcgaucgacggcaucaccaacaaggugaacuccgugaucgagaagaugaacacccaguucgaggccgucggcaaggaguucaacaaccuggagaagcggcucgagaaccugaacaagaagauggaggacggguuccuggacguguggaccuacaacgccgagcuccuggugcugauggagaacgagcgcacgcucgacuuccacgacagcaacgucaagaaccuguacgacaaggugcggaugcagcugaaggacaacgccaaggagcucggcaacgggugcuucgaguucuaccacaagugcgacgacgagugcaugaacuccgugaagaacggcaccuacgacuaccccaaguacgaggaggagagcaagcugaaccgcaacgagaucaagggcgucaagcuguccaacauggggguguaccagauccucgccaucuacgcgaccgucgccggcagccugucccuggccaucaugaucgccggggugagccucuggaugugcuccaacggcagccugcagugccggaucugcaucuga

SEQ ID NO: 71184 - RNA, 1689 nt, Artificial Sequence
  derived and/or modified sequence opt1 from hemagglutinin__InfluenzaA__AGQ80948
auggccaucaucuaccugauccuccuguucgccgcggugcgcggcgaccagaucugcaucggguaccacagcaacaacuccaccgagaaggucgacaccauccuggagcggaacgugacggugacccacgcccaggacauccucgagaagacccacaacggcaagcugugcaagcugaacgggaucccgccccucgagcugggcaacugcagcaucgccggguggcugcucggcaaccccgagugcgaccgccugcugaccguccccgagugguccuacaucauggagaaggagaacccccggaacggccucugcuacccggggagcuucaacgacuacgaggagcugaagcaccuccuguccagcgugacgcacuucgagaaggugaagauccugcccaaggaccgcuggacccagcacaccaccacgggcgggucccgggccugcgccgucuucggcaaccccagcuucuuccgcaacaugguguggcugaccaagaagggguccaacuaccccaucgcgaagggcagcuacaacaacaccuccggcgagcagaugcucaucaucuggggcgugcaccacccgaacgacgacgccgagcagcggacccuguaccagaacgucgggacguacgugagcguggggaccuccacccugaacaagcgcagcauccccgagaucgccacccggcccaaggucaacggccagggcgggcgcauggaguucuccuggacgauccucgacaugcuggacaccaucaacuucgagagcaccggcaaccugaucgcccccgaguacggguucaagaucuccaagcggggcagcuccgggaucaugaagaccgagggcacgcucgagaacugcgagaccaagugccagaccccgcugggcgcgaucaacaccacgcugcccuuccacaacauccacccccucaccaucggggagugccccaaguacgucaagagcgagcgccuggugcuggccaccggccuccggaacgugccgcagaucgagagccgcgggcuguucggcgccaucgccggguucaucgagggcggcuggcaggggaugguggacggcugguacggguaccaccacuccaacgaccagggcagcggguacgccgcggacaaggaguccacccagaaggccaucgacggcaucacgaacaaggugaacagcgucaucgagaagaugaacacccaguucgaggccgugggcaaggaguucaacaaccuggagaagcggcucgagaaccugaacaagaagauggaggacggguuccuggacguguggaccuacaacgccgagcuccugguccugauggagaacgagcgcacccucgacuuccacgacuccaacgugaagaaccuguacgacaagauccggaugcagcugaaggacaacgccaaggagcucggcaacgggugcuucgaguucuaccacaagugcgacgacgagugcaugaacagcgugaagaacggcacguacgacuaccccaaguacgaggaggaguccaagcugaaccgcaacgagaucaagggcgucaagcugagcaacauggggguguaccagauccucgcgaucuacgccaccgucgccggcucccugagccuggccaucaugaucgccgggaucucccucuggaugugcagcaacggcucccugcagugccggaucugcaucuga

SEQ ID NO: 71185 - RNA, 1689 nt, Artificial Sequence
  derived and/or modified sequence opt1 from hemagglutinin__InfluenzaA__AGQ80949
auggccaucaucuaccugauccuccuguucgccgcggugcgcggcgaccagaucugcaucggguaccacagcaacaacuccaccgagaaggucgacaccauccuggagcggaacgugacggugacccacgcccaggacauccucgagaagacccacaacggcaagcugugcaagcugaacgggaucccgccccucgagcugggcgacugcagcaucgccggguggcugcucggcaaccccgagugcgaccgccugcugaccguccccgagugguccuacaucauggagaaggagaacccccggaacggccucugcuacccggggagcuucaacgacuacgaggagcugaagcaccuccuguccagcgugacgcacuucgagaaggugaagauccugcccaaggaccgcuggacccagcacaccaccacgggcgggucccgggccugcgccgucagcggcaaccccuccuucuuccgcaacaugguguggcugaccaagaaggggagcaacuaccccaucgcgaagggcuccuacaacaacaccagcggcgagcagaugcucaucaucuggggcgugcaccacccgaacgacgacgccgagcagcggacccuguaccagaacgucgggacguacguguccguggggaccagcacccugaacaagcgcuccauccccgagaucgccacccggcccaaggucaacggccagggcgggcgcauggaguucagcuggacgauccucgacaugcuggacaccaucaacuucgaguccaccggcaaccugaucgcccccgaguacggguucaagaucagcaagcggggcuccagcgggaucaugaagaccgagggcacgcucgagaacugcgagaccaagugccagaccccgcugggcgcgaucaacaccacgcugcccuuccacaacauccacccccucaccaucggggagugccccaaguacgucaagagcgagcgccuggugcuggccaccggccuccggaacgugccgcagaucgagucccgcgggcuguucggcgccaucgccggguucaucgagggcggcuggcaggggaugguggacggcugguacggguaccaccacagcaacgaccagggcuccggguacgccgcggacaaggagagcacccagaaggccaucgacggcaucacgaacaaggugaacuccgucaucgagaagaugaacacccaguucgaggccgugggcaaggaguucaacaaccuggagaagcggcucgagaaccugaacaagaagauggaggacggguuccuggacguguggaccuacaacgccgagcuccugguccugauggagaacgagcgcacccucgacuuccacgacagcaacgugaagaaccuguacgacaagauccggaugcagcugaaggacaacgccaaggagcucggcaacgggugcuucgaguucuaccacaagugcgacgacgagugcaugaacuccgugaagaacggcacguacgacuaccccaaguacgaggaggagagcaagcugaaccgcaacgagaucaagggcgucaagcuguccaacauggggguguaccagauccucgcgaucuacgccaccgucgccggcagccugucccuggccaucaugaucgccgggaucagccucuggaugugcuccaacggcagccugcagugccggaucugcaucuga

SEQ ID NO: 71186 - RNA, 1701 nt, Artificial Sequence
  derived and/or modified sequence opt1 from hemagglutinin__InfluenzaA__AGQ80950
augaagaccaucaucgcccugagcuacaucuucugccucgccuucggccagaaccugcccgggaacgacuccagcaccgcgacgcugugccucggccaccacgccgugcugaacgggaccaucgucaagaccaucaccgacgaccagaucgaggugacgaacgccaccgagcuggugcaguccagcuccaccggcaagaucugcaacaacccgcacaagauccucgacgggcgcgacugcacccugaucgacgcccugcucggcgacccccacugcgacgucuuccaggacgagacgugggaccuguucguggagcggagcuccgccuucagcaacugcuaccccuacgacgugcccgacuacgcgucccugcgcagccucgucgccuccagcggcacccuggaguucaucaccgagggguucaccuggacgggcgugucccagaacgggggcagcggggccugcaagcggggcccggccaacggcuucuucucccgccugaacuggcucaccaagagcgggaacgcguaccccgugcugaacgucaccaugcccaacuccgacaacuucgacaagcuguacaucuggggcgugcaccaccccagcaccaaccaggagcagacgaaccucuacgugcaggccuccgggcgggucaccgugagcacccgccggagccagcagaccaucaucccgaacaucggcucccgccccugggugcggggccagagcgggcgcaucuccaucuacuggacgaucgucaagcccggcgacgugcuggugaucaacagcaacgggaaccugaucgcgccccggggcuacuucaagaugcgcaccgggaaguccagcaucaugcgguccgacgccccgaucgagaccugcaucagcgagugcaucacccccaacggcuccauccccaacgacaagcccuuccagaacgucaacaagaucacguacggcgccugcccgaaguacgugaagcagaacacccucaagcuggccaccgggaugcgcaacgugcccgagaagcagacccggggccuguucggggccaucgccggcuucaucgagaacgggugggagggcaugaucgacggcugguacggguuccgccaccagaacagcgagggcacggggcaggccgccgaccucaaguccacccaggcggccaucgaccagaucaacggcaagcugaaccgggucaucgagaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagaagacccggcgccagcuccgggagaacgccgaggacaugggcaacggcugcuucaagaucuaccacaagugcgacaacgcgugcaucgaguccauccgcaacgggaccuacgaccacgacaucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagcgcggcaacauccggugcaacaucugcaucuga

SEQ ID NO: 71187 - RNA, 1695 nt, Artificial Sequence
  derived and/or modified sequence opt1 from hemagglutinin__InfluenzaA__AGQ80951
augcugagcaucgugauccucuuccugcuggucgccgaguccagcucccagaacuacaccggcaaccccgugaucugcauggggcaccacgccguggcgaacggcaccauggucaagacgcucaccgacgaccagguggagguggucaccgcccaggagcugguggagagccagaaccugccggagcucugccccagcccccugcgccugguggacgggcagaccugcgacaucaucaacggcgcccucgggagccccggcugcgaccaccugaacggcgccgagugggacaucuucaucgagcggccgaacgccauggacacgugcuaccccuucgacguccccgacuaccagucccugcgcagcauccucgcgaacaacgggaaguucgaguucaucgccgaggaguuccagugguccaccgugaagcagaacggcaagagcggggccugcaagcgggccaacgugaacgacuucuucaaccgccugaacuggcuggucaaguccgacggcaacgcguacccccuccagaaccugaccaaggugaacaacggggacuacgcccggcuguacaucuggggcgugcaccacccgagcaccgacacggagcagaccaaccucuacaagaacaaccccggccgcgucaccguguccaccaagacgagccagaccuccgugguccccaacaucgggagccggcccugggugcgcggccaguccgggcggaucagcuucuacuggaccaucguggagccgggcgaccugaucgucuucaacaccaucggcaaccugaucgcgccccgcgggcacuacaagcucaacucccagaagaaguccacgauccugaacaccgccacccccaucggcagcugcguguccaagugccacaccgacaaggggagccuguccacgaccaagcccuuccagaacaucagccggguggccaucggcgacugcccgaaguacgucaagcaggggucccucaagcuggccaccggcaugcgcaacauccccgagaaggccagccggggccuguucggggccaucgccggcuucaucgagaacggguggcagggccucaucgacgggugguacggcuuccgccaccagaacgccgagggcaccgggacggcggccgaccugaaguccacccaggccgccaucgaccagaucaacggcaagcugaaccggcucaucgagaagaccaacgagaaguaccaccagaucgagaaggaguucgagcaggucgaggggcgcauccaggaccuggagaaguacguggaggacaccaagaucgaccuguggagcuacaacgccgagcuccugguggcgcuggagaaccagcacacgaucgacgugaccgacuccgagaugaacaagcuguucgagcggguccgccggcagcuccgcgagaacgccgaggacaagggcaacgggugcuucgagaucuuccacaagugcgacaacaacugcaucgagagcauccggaacggcaccuacgaccacgacguguaccgcaacgaggccaucaacaaccgcuuccagauccagggcgugaagcugacccagggguacaaggacaucauccucuggaucuccuucagcaucuccugcuuccugcuggucgcccuccugcuggccuucauccucugggcgugccagaacggcaacauccggugccagaucugcaucuga

SEQ ID NO: 71188 - RNA, 1683 nt, Artificial Sequence
  derived and/or modified sequence opt1 from hemagglutinin__InfluenzaA__AGQ80953
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugcgaccaguuccucgaguucuccgccgaccugaucaucgagcgccgggaggggagcgacgugugcuaccccggcaaguucgucaacgaggaggcgcugcgccagauccuccgggaguccgggggcaucgacaaggagacgaugggguucaccuacagcggcauccgcaccaacggcgccaccuccgccugccggcgcagcggguccagcuucuacgccgagaugaaguggcugcuguccaacacggacaacgcggccuucccccagaccaccaagagcuacaagaacacccggaaggaccccgcccucaucaucuggggcauccaccacuccgggagcacgaccgagcagaccaagcuguacggcuccggcaacaagcugaucaccguggggagcuccaacuaccagcagagcuucgugcccucccccggcgcccgcccgcaggucaacgggcagagcggccggaucgacuuccacuggcucaugcugaaccccaacgacacggugaccuucagcuucaacggggccuucaucgcgcccgaccgcgccuccuuccugcggggcaagagcaugggcauccaguccggggugcaggucgacgccaacugcgagggcgacugcuaccacaacgggggcaccaucaucagcaaccuccccuuccagaacaucaacucccgcgccguggggaagugcccgcgguacgugaagcaggagagccugcugcucgccaccggcaugaagaacguccccgagauccccaagggccgcgggcuguucggcgcgaucgccggguucaucgagaacggcugggaggggcugaucgacggcugguacggcuuccggcaccagaacgcccagggggagggcacggccgccgacuacaaguccacccagagcgcgaucgaccagaucaccgggaagcucaaccgccugaucgagaagaccaaccagcaguucgagcugaucgacaacgaguucacggagguggagcggcagaucggcaacgugaucaacuggacccgcgacuccaugaccgaggucuggagcuacaacgccgagcuccugguggccauggagaaccagcacaccaucgaccuggccgacuccgagaugaacaagcucuacgagcgcgugcggcgccagcugcgggagaacgccgaggaggacggcacggggugcuucgagaucuuccacaagugcgacgacgacugcauggcgagcauccgcaacaacaccuacgaccacuccaaguaccgggaggaggccaugcagaaccgcauccagaucgaccccgucaagcugagcuccggcuacaaggacgugauccucugguucagcuucggggccuccugcuucauccugcuggccaucgcgaugggccucgucuucaucugcgugaagaacgggaacaugcggugcaccaucugcaucuga

SEQ ID NO: 71189 - RNA, 1683 nt, Artificial Sequence; identical to SEQ ID NO: 71188
  derived and/or modified sequence opt1 from hemagglutinin__InfluenzaA__AGQ80954

SEQ ID NO: 71190 - RNA, 1683 nt, Artificial Sequence; identical to SEQ ID NO: 71188
  derived and/or modified sequence opt1 from hemagglutinin__InfluenzaA__AGQ80955

SEQ ID NO: 71191 - RNA, 1683 nt, Artificial Sequence; identical to SEQ ID NO: 71188
  derived and/or modified sequence opt1 from hemagglutinin__InfluenzaA__AGQ80956

SEQ ID NO: 71192 - RNA, 1683 nt, Artificial Sequence; identical to SEQ ID NO: 71188
  derived and/or modified sequence opt1 from hemagglutinin__InfluenzaA__AGQ80957

SEQ ID NO: 71193 - RNA, 1683 nt, Artificial Sequence; identical to SEQ ID NO: 71188
  derived and/or modified sequence opt1 from hemagglutinin__InfluenzaA__AGQ80958

SEQ ID NO: 71194 - RNA, 1683 nt, Artificial Sequence
  derived and/or modified sequence opt1 from hemagglutinin__InfluenzaA__AGQ80959
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccccagaugaccaaguccuacaagaacacccggaaggaccccgcccucaucaucuggggcauccaccacagcggguccaccgccgagcagacgaagcuguacggcagcggcaacaagcuggucaccgugggguccagcaacuaccagcaguccuucgugcccagccccggcgcccgcccgcaggucaacgggcaguccggccggaucgacuuccacuggcucaugcugaaccccaacgacaccgugaccuucagcuucaacggggcguucaucgcccccgaccgcgccagcuuccugcggggcaaguccaugggcauccagagcggggugcaggucgacgccaacugcgagggcgacugcuaccacgggggcgggacgaucaucuccaaccuccccuuccagaacaucgacagccgcgccgugggcaagugcccgcgguacgugaagcagaagucccugcugcucgcgaccggcaugaagaacguccccgagagccccaaggggcgcggccuguucggggccaucgccggcuucaucgagaacgggugggagggccugaucgacggcugguacggguuccggcaccagaacgcccagggcgaggggaccgccgcggacuacaaguccacccagagcgccaucgaccagaucacgggcaagcucaaccgccugaucgagaagaccaaccagcaguucgagcugaucgacaacgaguucaccgagguggagaagcagaucggcaacgugaucaacuggacccgggacuccaucacggaggucuggagcuacaacgccgagcuccugguggccauggagaaccagcacaccaucgaccuggccgacuccgagaugaacaagcucuacgagcgcgugaagcgccagcugcgggagaacgcggaggaggacgggaccggcugcuucgagaucuuccacaagugcgacgacgacugcauggccagcauccgcaacaacaccuacgaccacuccaaguaccgggaggaggccaugcagaaccgcauccagaucgaccccgucaagcugagcuccggguacaaggacgugauccucugguucagcuucggcgccuccugcuucauccugcuggcgaucgccauggggcucgucuucaucugcgugaagaacggcaacaugcggugcacgaucugcaucuga

SEQ ID NO: 71195 - RNA, 1683 nt, Artificial Sequence
  derived and/or modified sequence opt1 from hemagglutinin__InfluenzaA__AGQ80961
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccaacgugccgaagaucugcuccaaggggaagcgcaccguggaccucggccagugcgggcugcugggcaccaucacgggcccgccccagugcgaccaguuccucgaguucagcgccgaccugaucaucgagcggcgcgagggguccgacgucugcuaccccggcaaguucgugaacgaggagacccugcggcagauccuccgcgagagcgggggcaucgacaaggagaccaugggguucaccuacuccggcauccggacgaacggcgccaccagcgcgugccgccgguccgggagcuccuucuacgccgagaugaaguggcugcugagcaacaccgacaacgccgccuucccgcagaugaccaaguccuacaagaacgcgcgcaaggaccccgcccucaucaucuggggcauccaccacagcggguccacgaccgagcagaccaagcuguacggcagcggcaacaagcugaucaccgugggguccagcaacuaccagcaguccuucguccccagccccggcgcccggccccaggugaacgggcaguccggccgcaucgacuuccacuggcucaugcugaaccccaacgacacggugaccuucagcuucaacggggccuucaucgcccccgaccgggcgugcuuccugcgcggcaagagcaugggcauccaguccgggguccagguggacgccagcugcgagggcgacugcuaccacuccgggggcaccaucaucagcaaccuccccuuccagaacaucaacucccgggccguggggaagugcccgcgcuacgucaagcaggagagccugaugcuggccaccggcaugaagaacgugcccgagauccccaagggccggggccucuucggggccaucgcgggguucaucgagaacggcugggaggggcugaucgacggcugguacggcuuccgccaccagaacgcccagggggagggcacggccgccgacuacaaguccacccagagcgccaucgaccagaucaccgggaagcugaaccggcucaucgagaagaccaaccagcaguucgagcugaucgacaacgaguucacggagguggagaagcagaucggcaacgucaucaacuggacccgcgacuccaugaccgagguguggagcuacaacgcggagcugcucguggccauggagaaccagcacaccaucgaccuggccgacuccgagaugaacaagcuguacgagcgggucaagcgccagcuccgcgagaacgccgaggaggacggcacggggugcuucgagaucuuccacaagugcgacgacgacugcauggccagcauccggaacaacaccuacgaccacuccaaguaccgcgaggaggcgaugcagaaccggaucaagaucgaccccgugaagcugagcuccggcuacaaggacgucauccugugguucagcuucggggccuccugcuucauccuccuggccaucgccaugggccugguguucaucugcgugaagaacgggaacaugcgcugcaccaucugcaucuga

SEQ ID NO: 71196 - RNA, 1683 nt, Artificial Sequence; identical to SEQ ID NO: 71195
  derived and/or modified sequence opt1 from hemagglutinin__InfluenzaA__AGQ80962

SEQ ID NO: 71197 - RNA, 1683 nt, Artificial Sequence
  derived and/or modified sequence opt1 from hemagglutinin__InfluenzaA__AGQ80964
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccccagaugaccaaguccuacaagaacacccggaaggaccccgcccucaucaucuggggcauccaccacagcggguccaccgccgagcagacgaagcuguacggcagcggcaacaagcuggucaccgugggguccagcaacuaccagcaguccuucgugcccagccccggcgcccgcccgcaggucaacgggcaguccggccggaucgacuuccacuggcucaugcugaaccccaacgacaccgugaccuucagcuucaacggggcguucaucgcccccgaccgcgccagcuuccugcggggcaaguccaugggcauccagagcggggugcaggucgacgccgacugcgagggcgacugcuaccacuccgggggcacgaucaucagcaaccuccccuuccagaacaucgacucccgcgccguggggaagugcccgcgguacgugaagcagcgcagccugcugcucgcgaccggcaugaagaacguccccgagauccccaagggccgggggcuguucggcgccaucgccggguucaucgagaacggcugggaggggcugaucgacggcugguacggcuuccgccaccagaacgcccagggggagggcaccgccgcggacuacaaguccacccagagcgccaucgaccagaucacggggaagcucaaccggcugaucgagaagaccaaccagcaguucgagcugaucgacaacgaguucaccgagguggagaagcagaucggcaacgugaucaacuggacccgcgacuccaucacggaggucuggagcuacaacgccgagcuccugguggccauggagaaccagcacaccaucgaccuggccgacuccgagaugaacaagcucuacgagcgcgugaagcggcagcugcgcgagaacgcggaggaggacggcaccgggugcuucgagaucuuccacaagugcgacgacgacugcauggccagcauccggaacaacaccuacgaccacuccaaguaccgcgaggaggccaugcagaaccggauccagaucgaccccgucaagcugagcuccggcuacaaggacgugauccucugguucagcuucggggccuccugcuucauccugcuggcgaucgccaugggccucgucuucaucugcgugaagaacgggaacaugcgcugcacgaucugcaucuga

SEQ ID NO: 71198 - RNA, 1683 nt, Artificial Sequence; identical to SEQ ID NO: 71188
  derived and/or modified sequence opt1 from hemagglutinin__InfluenzaA__AGQ80965

SEQ ID NO: 71199 - RNA, 1683 nt, Artificial Sequence; identical to SEQ ID NO: 71188
  derived and/or modified sequence opt1 from hemagglutinin__InfluenzaA__AGQ80966

SEQ ID NO: 71200 - RNA, 1683 nt, Artificial Sequence; identical to SEQ ID NO: 71188
  derived and/or modified sequence opt1 from hemagglutinin__InfluenzaA__AGQ80968

SEQ ID NO: 71201 - RNA, 1683 nt, Artificial Sequence
  derived and/or modified sequence opt1 from hemagglutinin__InfluenzaA__AGQ80970
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagaaggccguggaccucggccagugcgggcugcugggcaccaucaccggcccgccccagugcgaccaguuccucgaguucuccgccgaccugaucaucgagcggcgcgaggggagcgacgugugcuaccccggcaaguucgucaacgaggaggcgcugcggcagauccuccgcgaguccgggggcaucgacaaggagacgaugggguucaccuacagcggcauccggaccaacggcgccaccuccgccugccgccggagcggguccagcuucuacgccgagaugaaguggcugcuguccaacacggacaacgcggccuucccccagaccaccaagagcuacaagaacacccgcaaggaccccgcccucaucaucuggggcauccaccacuccgggagcacgaccgagcagaccaagcuguacggcuccggcaacaagcugaucaccguggggagcuccaacuaccagcagagcuucgugcccucccccggcgcccggccgcaggucaacgggcagagcggccgcaucgacuuccacuggcucaugcugaaccccaacgacacggugaccuucagcuucaacggggccuucaucgcgcccgaccgggccuccuuccugcgcggcaagagcaugggcauccaguccggggugcaggucgacgccaacugcgagggcgacugcuaccacaacgggggcaccaucaucagcaaccuccccuuccagaacaucaacucccgggccguggggaagugcccgcgcuacgugaagcaggagagccugcugcucgccaccggcaugaagaacguccccgagauccccaagggccgggggcuguucggcgcgaucgccggguucaucgagaacggcugggaggggcugaucgacggcugguacggcuuccgccaccagaacgcccagggggagggcacggccgccgacuacaaguccacccagagcgcgaucgaccagaucaccgggaagcucaaccggcugaucgagaagaccaaccagcaguucgagcugaucgacaacgaguucacggagguggagcgccagaucggcaacgugaucaacuggacccgggacuccaugaccgaggucuggagcuacaacgccgagcuccugguggccauggagaaccagcacaccaucgaccuggccgacuccgagaugaacaagcucuacgagcgcgugcgccggcagcugcgcgagaacgccgaggaggacggcacggggugcuucgagaucuuccacaagugcgacgacgacugcauggcgagcauccggaacaacaccuacgaccacuccaaguaccgcgaggaggccaugcagaaccggauccagaucgaccccgucaagcugagcuccggcuacaaggacgugauccucugguucagcuucggggccuccugcuucauccugcuggccaucgcgaugggccucgucuucaucugcgugaagaacgggaacaugcgcugcaccaucugcaucuga

SEQ ID NO: 71202 - RNA, 1683 nt, Artificial Sequence
  derived and/or modified sequence opt1 from hemagglutinin__InfluenzaA__AGQ80971
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagaagaccguggaccucggccagugcgggcugcugggcaccaucacgggcccgccccagugcgaccaguuccucgaguucuccgccgaccugaucaucgagcggcgcgaggggagcgacgugugcuaccccggcaaguucgucaacgaggaggcccugcggcagauccuccgcgaguccgggggcaucgacaaggagaccaugggguucaccuacagcggcauccggaccaacggcgcgacguccgccugccgccggagcggguccagcuucuacgccgagaugaaguggcugcuguccaacaccgacaacgccgcguucccccagaccaccaagagcuacaagaacacgcgcaaggaccccgcccucaucaucuggggcauccaccacuccgggagcaccaccgagcagaccaagcuguacggcuccggcaacaagcugaucacgguggggagcuccaacuaccagcagagcuucgugcccucccccggcgcccggccgcaggucaacgggcagagcggccgcaucgacuuccacuggcucaugcugaaccccaacgacaccgugaccuucagcuucaacggggccuucaucgcccccgaccgggcguccuuccugcgcggcaagagcaugggcauccaguccggggugcaggucgacgccaacugcgagggcgacugcuaccacaacgggggcaccaucaucagcaaccuccccuuccagaacaucaacucccgggccguggggaagugcccgcgcuacgugaagcaggagagccugcugcucgccacgggcaugaagaacguccccgagauccccaagggccgggggcuguucggcgccaucgcgggguucaucgagaacggcugggaggggcugaucgacggcugguacggcuuccgccaccagaacgcccagggggagggcaccgccgccgacuacaaguccacccagagcgccaucgaccagaucaccgggaagcucaaccggcugaucgagaagacgaaccagcaguucgagcugaucgacaacgaguucaccgagguggagcgccagaucggcaacgugaucaacuggacccgggacuccaugaccgaggucuggagcuacaacgcggagcuccugguggccauggagaaccagcacacgaucgaccuggccgacuccgagaugaacaagcucuacgagcgcgugcgccggcagcugcgcgagaacgccgaggaggacggcaccgggugcuucgagaucuuccacaagugcgacgacgacugcauggccagcauccggaacaacaccuacgaccacuccaaguaccgcgaggaggcgaugcagaaccggauccagaucgaccccgucaagcugagcuccggcuacaaggacgugauccucugguucagcuucggggccuccugcuucauccugcuggccaucgccaugggccucgucuucaucugcgugaagaacgggaacaugcgcugcaccaucugcaucuga

SEQ ID NO: 71203 - RNA, 1683 nt, Artificial Sequence
  derived and/or modified sequence opt1 from hemagglutinin__InfluenzaA__AGQ80974
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugcgaccaguuccucgaguucuccgccgaccugaucaucgagcgccgggaggggagcgacgugugcuaccccggcaaguucgucaacgaggaggcgcugcgccagauccuccgggaguccgggggcaucgacaaggagacgaugggguucaccuacagcggcauccgcaccaacggcgccaccuccgccugccggcgcagcggguccagcuucuacgccgagaugaaguggcugcuguccaacacggacaacgcggccuucccccagaccaccaagagcuacaagaacacccggaaggaccccgcccucaucaucuggggcauccaccacuccgggagcacgaccgagcagaccaagcuguacggcuccggcaacaagcugaucaccguggggagcuccaacuaccagcagagcuucgugcccucccccggcgcccgcccgcaggucaacgggcagagcggccggaucgacuuccacuggcucaugcugaaccccaacgacacggugaccuucagcuucaacggggccuucaucgcgcccgaccgcgccuccuuccugcggggcaagagcaugggcauccaguccggggugcaggucgacgccaacugcgagggcgacugcuaccacaacgggggcaccaucaucagcaaccuccccuuccagaacaucaacucccgcgccguggggaagugcccgcgguacgugaagcaggagagccugcugcucgccaccggcaugaagaacguccccgagauccccaagggccgcgggcuguucggcgcgaucgccggguucaucgagaacggcugggaggggcugguggacggcugguacggcuuccggcaccagaacgcccagggggagggcacggccgccgacuacaaguccacccagagcgcgaucgaccagaucaccgggaagcucaaccgccugaucgagaagaccaaccagcaguucgagcugaucgacaacgaguucacggagguggagcggcagaucggcaacgucaucaacuggacccgcgacuccaugaccgagguguggagcuacaacgccgagcuccugguggccauggagaaccagcacaccaucgaccuggccgacuccgagaugaacaagcucuacgagcgcguccggcgccagcugcgggagaacgccgaggaggacggcacggggugcuucgagaucuuccacaagugcgacgacgacugcauggcgagcauccgcaacaacaccuacgaccacuccaaguaccgggaggaggccaugcagaaccgcauccagaucgaccccgugaagcugagcuccggcuacaaggacgucauccucugguucagcuucggggccuccugcuucauccugcuggccaucgcgaugggccucguguucaucugcgugaagaacgggaacaugcggugcaccaucugcaucuga

SEQ ID NO: 71204 - RNA, 1683 nt, Artificial Sequence
  derived and/or modified sequence opt1 from hemagglutinin__InfluenzaA__AGQ80977
augaacacccagauccuggcccucgcccuggcggccaucauccccaccaacgccgacaagaucugccugggccaccacgccgugagcaacgggacgaaggugaacacccucaccgagcgcggcguggagguggucaacgccaccgagacgguggagcggaccuccaucccgcgcaucugcagcaaggggaagcgggcgguggaccugggccagugcgggcugcucggcaccaucaccggcccgccccagugcgaccaguuccuggaguucuccgccgaccugaucaucgagcgccgggaggggagcgacgucugcuaccccggcaaguucgugaacgaggaggcccuccgccagauccugcgggaguccgggggcaucgacaaggagacgaugggguucaccuacagcggcauccgcaccaacggcgccaccuccgcgugccggcgcagcggguccagcuucuacgccgagaugaaguggcugcucuccaacacggacaacgccgccuucccgcagaccaccaagagcuacaagaacacccggaaggaccccgcccugaucaucuggggcgugcaccacuccgggagcacgaccgagcagaccaagcuguacggcuccggcaacaagcucaucaccgucgggagcuccaacuaccagcagagcuucgugcccucccccggcgcgcgcccccaggugaacgggcagagcggccggaucgacuuccacuggcugaugcugaaccccaacgacacggucaccuucagcuucaacggggccuucaucgcccccgaccgcgccuccuuccuccggggcaagagcaugggcauccaguccgggguccagguggacgccaacugcgagggcgacugcuaccacaacgggggcaccaucaucagcaaccugcccuuccagaacaucaacucccgcgcgguggggaagugcccgcgguacgugaagcaggagagccugcuccuggccaccggcaugaagaacgugcccgagauccccaagggccgcgggcuguucggcgccaucgccggguucaucgagaacggcugggaggggcucgucgacggcugguacggcuuccggcaccagaacgcccagggggagggcacggcggccgacuacaaguccacccagagcgccaucgaccagaucaccgggaagcugaaccgccugaucgagaagaccaaccagcaguucgagcucaucgacaacgaguucacggagguggagcggcagaucggcaacgugaucaacuggacccgcgacuccaugaccgaggucuggagcuacaacgccgagcugcugguggccauggagaaccagcacaccaucgaccucgcggacuccgagaugaacaagcuguacgagcgcgugcggcgccagcugcgggagaacgccgaggaggacggcacggggugcuucgagaucuuccacaagugcgacgacgacugcauggccagcauccgcaacaacaccuacgaccacuccaaguaccgggaggaggccaugcagaaccgcauccagaucgaccccgucaagcucagcuccggcuacaaggacgugauccugugguucagcuucggggcguccugcuucauccugcucgccaucgccaugggccuggucuucaucugcgucaagagcgggaacaugcggugcaccaucugcaucuga

SEQ ID NO: 71205 - RNA, 1683 nt, Artificial Sequence
  derived and/or modified sequence opt1 from hemagglutinin__InfluenzaA__AGQ80978
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugcgaccaguuccucgaguucuccgccgaccugaucaucgagcgccgggaggggagcgacgugugcuaccccggcaaguucgucaacgaggaggcgcugcgccagauccuccgggaguccgggggcaucgacaaggagacgaugggguucaccuacagcggcauccgcaccaacggcgccaccuccgccugccggcgcagcggguccagcuucuacgccgagaugaaguggcugcuguccaacacggacaacgcggccuucccccagaccaccaagagcuacaagaacacccggaaggaccccgcccucaucaucuggggcauccaccacuccgggagcaucacggagcagaccaagcuguacggcuccggcaacaagcugaucaccguggggagcuccaacuaccagcagagcuucgugcccucccccggcgcccgcccgcaggucaacgggcagagcggccggaucgacuuccacuggcucaugcugaaccccaacgacaccgugacguucagcuucaacggggccuucaucgcgcccgaccgcgccuccuuccugcggggcaagagcaugggcauccaguccggggugcaggucgacgccaacugcgagggcgacugcuaccacaacgggggcaccaucaucagcaaccuccccuuccagaacaucaacucccgcgccguggggaagugcccgcgguacgugaagcaggagagccugcugcucgccaccggcaugaagaacguccccgagauccccaagggccgcgggcuguucggcgcgaucgccggguucaucgagaacggcugggaggggcugguggacggcugguacggcuuccggcaccagaacgcccagggggagggcaccgccgccgacuacaaguccacgcagagcgcgaucgaccagaucaccgggaagcucaaccgccugaucgagaagaccaaccagcaguucgagcugaucgacaacgaguucaccgagguggagcggcagaucggcaacgucaucaacuggacgcgcgacuccaugaccgagguguggagcuacaacgccgagcuccugguggccauggagaaccagcacaccaucgaccuggccgacuccgagaugaacaagcucuacgagcgcguccggcgccagcugcgggagaacgccgaggaggacggcaccgggugcuucgagaucuuccacaagugcgacgacgacugcauggcgagcauccgcaacaacacguacgaccacuccaaguaccgggaggaggccaugcagaaccgcauccagaucgaccccgugaagcugagcuccggcuacaaggacgucauccucugguucagcuucggggccuccugcuucauccugcuggccaucgcgaugggccucguguucaucugcgugaagaacgggaacaugcggugcaccaucugcaucuga

SEQ ID NO: 71206 - RNA, 1683 nt, Artificial Sequence
  derived and/or modified sequence opt1 from hemagglutinin__InfluenzaA__AGQ80979
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugcgaccaguuccucgaguucuccgccgaccugaucaucgagcgccgggaggggagcgacgugugcuaccccggcaaguucgucaacgaggaggcgcugcgccagauccuccgggaguccgggggcaucgacaaggagacgaugggguucaccuacagcggcauccgcaccaacggcgccaccuccgccugccggcgcagcggguccagcuucuacgccgagaugaaguggcugcuguccaacacggacaacgcggccuucccccagaccaccaagagcuacaagaacacccggaaggaccccgcccucaucaucuggggcauccaccacuccgggagcacgaccgagcagaccaagcuguacggcuccggcaacaagcugaucaccguggggagcuccaacuaccagcagagcuucgugcccucccccggcgcccgcccgcaggucaacgggcagagcggccggaucgacuuccacuggcucaugcugaaccccaacgacacggugaccuucagcuucaacggggccuucaucgcgcccgaccgcgccuccuuccugcggggcaagagcaucggcauccaguccggggugcaggucgacgccaacugcgagggcgacugcuaccacaacgggggcaccaucaucagcaaccuccccuuccagaacaucaacucccgcgccguggggaagugcccgcgguacgugaagcaggagagccugcugcucgccaccggcaugaagaacguccccgagauccccaagggccgcgggcuguucggcgcgaucgccggguucaucgagaacggcugggaggggcugaucgacggcugguacggcuuccggcaccagaacgcccagggggagggcacggccgccgacuacaaguccacccagagcgcgaucgaccagaucaccgggaagcucaaccgccugaucgagaagaccaaccagcaguucgagcugaucgacaacgaguucacggagguggagcggcagaucggcaacgugaucaacuggacccgcgacuccaugaccgaggucuggagcuacaacgccgagcuccugguggccauggagaaccagcacaccaucgaccuggccgacuccgagaugaacaagcucuacgagcgcgugcggcgccagcugcgggagaacgccgaggaggacggcacggggugcuucgagaucuuccacaagugcgacgacgacugcauggcgagcauccgcaacaacaccuacgaccacuccaaguaccgggaggaggccaugcagaaccgcauccagaucgaccccgucaagcugagcuccggcuacaaggacgugauccucugguucagcuucggggccuccugcuucauccugcuggccaucgcgaugggccucgucuucaucugcgugaagaacgggaacaugcggugcaccaucugcaucuga

SEQ ID NO: 71207 - RNA, 1683 nt, Artificial Sequence; identical to SEQ ID NO: 71203
  derived and/or modified sequence opt1 from hemagglutinin__InfluenzaA__AGQ80980

SEQ ID NO: 71208 - RNA, 1683 nt, Artificial Sequence; identical to SEQ ID NO: 71188
  derived and/or modified sequence opt1 from hemagglutinin__InfluenzaA__AGQ80981

SEQ ID NO: 71209 - RNA, 1683 nt, Artificial Sequence; identical to SEQ ID NO: 71188
  derived and/or modified sequence opt1 from hemagglutinin__InfluenzaA__AGQ80982

SEQ ID NO: 71210 - RNA, 1683 nt, Artificial Sequence; identical to SEQ ID NO: 71188
  derived and/or modified sequence opt1 from hemagglutinin__InfluenzaA__AGQ80983

SEQ ID NO: 71211 - RNA, 1683 nt, Artificial Sequence; identical to SEQ ID NO: 71188
  derived and/or modified sequence opt1 from hemagglutinin__InfluenzaA__AGQ80984

SEQ ID NO: 71212 - RNA, 1683 nt, Artificial Sequence; identical to SEQ ID NO: 71188
  derived and/or modified sequence opt1 from hemagglutinin__InfluenzaA__AGQ80985

SEQ ID NO: 71213 - RNA, 1683 nt, Artificial Sequence; identical to SEQ ID NO: 71188
  derived and/or modified sequence opt1 from hemagglutinin__InfluenzaA__AGQ80986

SEQ ID NO: 71214 - RNA, 1683 nt, Artificial Sequence; identical to SEQ ID NO: 71188
  derived and/or modified sequence opt1 from hemagglutinin__InfluenzaA__AGQ80987

SEQ ID NO: 71215 - RNA, 1683 nt, Artificial Sequence; identical to SEQ ID NO: 71188
  derived and/or modified sequence opt1 from hemagglutinin__InfluenzaA__AGQ80988

SEQ ID NO: 71216 - RNA, 1683 nt, Artificial Sequence
  derived and/or modified sequence opt1 from hemagglutinin__InfluenzaA__AGQ80990
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgaagaucugcagcaaggggaagcgcgccguggaccucggccagugcgggcugcugggcaccaucaccggcccgccccagugcgaccaguuccucgaguucuccgccgaccugaucaucgagcggcgcgaggggagcgacgugugcuaccccggcaaguucgucaacgaggaggcgcugcggcagauccuccgcgaguccgggggcaucgacaaggagacgaugggguucaccuacagcggcauccggaccaacggcgccaccuccgccugccgccggagcggguccagcuucuacgccgagaugaaguggcugcuguccaacacggacaacgcggccuucccccagaccaccaagagcuacaagaacacccgcaaggaccccgcccucaucaucuggggcauccaccacuccgggagcacgaccgagcagaccaagcuguacggcuccggcaacaagcugaucaccguggggagcuccaacuaccagcagagcuucgugcccucccccggcgcccggccgcaggucaacgggcagagcggccgcaucgacuuccacuggcucaugcugaaccccaacgacacggugaccuucagcuucaacggggccuucaucgcgcccgaccgggccuccuuccugcgcggcaagagcaugggcauccaguccggggugcaggucgacgccaacugcgagggcgacugcuaccacaacgggggcaccaucaucagcaaccuccccuuccagaacaucaacucccgggccguggggaagugcccgcgcuacgugaagcaggagagccugcugcucgccaccggcaugaagaacguccccgagauccccaagggccgggggcuguucggcgcgaucgccggguucaucgagaacggcugggaggggcugaucgacggcugguacggcuuccgccaccagaacgcccagggggagggcacggccgccgacuacaaguccacccagagcgcgaucgaccagaucaccgggaagcucaaccggcugaucgagaagaccaaccagcaguucgagcugaucgacaacgaguucacggagguggagcgccagaucggcaacgugaucaacuggacccgggacuccaugaccgaggucuggagcuacaacgccgagcuccugguggccauggagaaccagcacaccaucgaccuggccgacuccgagaugaacaagcucuacgagcgcgugcgccggcagcugcgcgagaacgccgaggaggacggcacggggugcuucgagaucuuccacaagugcgacgacgacugcauggcgagcauccggaacaacaccuacgaccacuccaaguaccgcgaggaggccaugcagaaccggauccagaucgaccccgucaagcugagcuccggcuacaaggacgugauccucugguucagcuucggggccuccugcuucauccugcuggccaucgcgaugggccucgucuucaucugcgugaagaacgggaacaugcgcugcaccaucugcaucuga

SEQ ID NO: 71217 - RNA, 1683 nt, Artificial Sequence; identical to SEQ ID NO: 71202
  derived and/or modified sequence opt1 from hemagglutinin__InfluenzaA__AGQ80991

SEQ ID NO: 71218 - RNA, 1683 nt, Artificial Sequence
  derived and/or modified sequence opt1 from hemagglutinin__InfluenzaA__AGQ80992
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccaacgugccgcgcaucugcuccaaggggaagcggaccguggaccucggccagugcgggcugcugggcaccaucacgggcccgccccagugcgaccaguuccucgaguucagcgccgaccugaucaucgagcgccgggagggguccgacgucugcuaccccggcaaguucaugaacgaggaggcccugcgccagauccuccgggagagcgggggcaucgacaaggagaccaugggguucaccuacuccggcauccgcaccaacggcgcgacgagcgccugccggcgcuccgggagcuccuucuacgccgagaugaaguggcugcugagcaacaccgacaacgccgcguucccccagaugaccaaguccuacaagaacacccggaaggaccccgcccucaucaucuggggcauccaccacagcggguccacgaccgagcagaccaagcuguacggcagcggcaacaagcugaucaccgugggguccagcaacuaccagcaguccuucgugcccagccccggcgcccgcccgcaggucaacgggcaguccggccggaucgacuuccacuggcucaugcugaaccccaacgacacggugaccuucagcuucaacggggccuucaucgcccccgaccgcgcgugcuuccugcggggcaagagcaugggcauccaguccggggugcaggucgacgccagcugcgagggcgacugcuaccacuccgggggcaccaucaucagcaaccuccccuuccagaacaucaacucccgcgccguggggaagugcccgcgguacgugaagcaggagagccugaugcuggccaccggcaugaagaacguccccgagauccccaagggccgcggccucuucggggccaucgcgggguucaucgagaacggcugggaggggcugaucgacggcugguacggcuuccggcaccagaacgcccagggggagggcacggccgccgacuacaaguccacccagagcgccaucgaccagaucaccgggaagcugaaccgccucaucgagaagaccaaccagcaguucgagcugaucgacaacgaguucacggagguggagaagcagaucggcaacgugaucaacuggacccgggacuccaugaccgaggucuggagcuacaacgcggagcugcucguggccauggagaaccagcacaccaucgaccuggccgacuccgagaugaacaagcuguacgagcgcgugaagcgccagcuccgggagaacgccgaggaggacggcacggggugcuucgagaucuuccacaagugcgacgacgacugcauggccagcauccgcaacaacaccuacgaccacuccaaguaccgggaggaggcgaugcagaaccgcauccagaucgaccccgucaagcugagcuccggcuacaaggacgugauccugugguucagcuucggggccuccugcuucauccuccuggccaucgccaugggccuggucuucaucugcgugaagaacgggaacaugcggugcaccaucugcaucuga

SEQ ID NO: 71219 - RNA, 1683 nt, Artificial Sequence; identical to SEQ ID NO: 71188
  derived and/or modified sequence opt1 from hemagglutinin__InfluenzaA__AGQ80993

SEQ ID NO: 71220 - RNA, 1683 nt, Artificial Sequence; identical to SEQ ID NO: 71195
  derived and/or modified sequence opt1 from hemagglutinin__InfluenzaA__AGQ80994

SEQ ID NO: 71221 - RNA, 1683 nt, Artificial Sequence; identical to SEQ ID NO: 71197
  derived and/or modified sequence opt1 from hemagglutinin__InfluenzaA__AGQ80995

SEQ ID NO: 71222 - RNA, 1683 nt, Artificial Sequence; identical to SEQ ID NO: 71197
  derived and/or modified sequence opt1 from hemagglutinin__InfluenzaA__AGQ80996

SEQ ID NO: 71223 - RNA, 1683 nt, Artificial Sequence
  derived and/or modified sequence opt1 from hemagglutinin__InfluenzaA__AGQ80997
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccaacaucccgcgcaucugcuccaaggggaagcggaccguggaccucggccagugcgggcugcugggcaccaucacgggcccgccccagugcgaccaguuccucgaguucagcgccgaccugaucaucgagcgccgggagggguccgacgugugcuaccccggcaaguucgucaacgaggaggcccugcgccagauccuccgggagagcgggggcaucgacaaggagaccaugggguucaccuacuccggcauccgcaccgacggcgcgacgagcgccugccggcgcuccgggagcuccuucuacgccgagaugaaguggcugcugagcaacaccgacaacgccgcguucccccagaugaccaaguccuacaagaacacccggaaggaccccgcccucaucaucuggggcauccaccacagcggguccacgaccgagcagaccaagcuguacggcagcggcaacaagcugaucaccgugggguccagcaacuaccagcaguccuucgugcccagccccggcgcccgcccgcaggucaacgggcaguccggccggaucgacuuccacuggcucaugcugaaccccaacgacacggugaccuucagcuucaacggggccuucaucgcccccgaccgcgcgagcuuccugcggggcaaguccaugggcauccagagcggggugcaggucgacgccaacugcgagggcgacugcuaccacuccgggggcaccaucaucagcaaccuccccuuccagaacaucaacucccgcgccguggggaagugcccgcgguacgugaagcaggagagccugcugcucgccaccggcaugaagaacguccccgagauccccaagggccgcgggcuguucggcgccaucgcgggguucaucgagaacggcugggaggggcugaucgacggcugguacggcuuccggcaccagaacucccagggggagggcacggccgccgacuacaagagcacccaguccgccaucgaccagaucaccgggaagcucaaccgccugaucgagaagaccaaccagcaguucgagcugaucgacaacgaguucacggagguggagaagcagaucggcaacgugaucaacuggacccgggacagcaugaccgaggucugguccuacaacgccgagcuccugguggcgauggagaaccagcacaccaucgaccuggccgacagcgagaugaacaagcucuacgagcgcgugaagcgccagcugcgggagaacgccgaggaggacggcacggggugcuucgagaucuuccacaagugcgacgacgacugcauggccuccauccgcaacaacaccuacgaccacagcaaguaccgggaggaggccaugcagaaccgcauccagaucgaccccgucaagcuguccagcggcuacaaggacgugauccucugguucuccuucggggcgagcugcuucauccugcuggccaucgccaugggccucgucuucaucugcgugaagaacgggaacaugcggugcaccaucugcaucuga

SEQ ID NO: 71224 - RNA, 1683 nt, Artificial Sequence
  derived and/or modified sequence opt1 from hemagglutinin__InfluenzaA__AGQ81000
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccaacaucccgcgcaucugcuccaaggggaagcggaccguggaccucggccagugcgggcugcugggcaccaucacgggcccgccccagugcgaccaguuccucgaguucagcgccgaccugaucaucgagcgccgggagggguccgacgugugcuaccccggcaaguucgucaacgaggaggcccugcgccagauccuccgggagagcgggggcaucgggaaggagaccaugggcuucaccuacuccggcauccgcaccaacggggcgacgagcgccugccggcgcuccggcagcuccuucuacgccgagaugaaguggcugcugagcaacaccgacaacgccgcguucccccagaugaccaaguccuacaagaacacccggaaggaccccgcccucaucaucugggggauccaccacagcggcuccacgaccgagcagaccaagcuguacggcagcgggaacaagcugaucaccgugggcuccagcaacuaccagaaguccuucgugcccagccccggggcccgcccgcaggucaacggccaguccgggcggaucgacuuccacuggcucaugcugaaccccaacgacacggugaccuucagcuucaacggcgccuucaucgcccccgaccgcgcgagcuuccugcggggcaaguccauggggauccagagcggcgugcaggucgacgccaacugcgagggggacugcuaccacaacggcgggaccaucaucuccaaccuccccuuccagaacaucaacagccgcgccgugggcaagugcccgcgguacgugaagcaggagucccugcugcucgccaccggcaugaagaacguccccgagauccccaaggggcgcggccuguucggggccaucgcgggcuucaucgagaacgggugggagggccugaucgacggcugguacggguuccggcaccagaacgcccagggcgaggggacggccgccgacuacaagagcacccaguccgccaucgaccagaucaccggcaagcucaaccgccugaucgagaagaccaaccagcaguucgagcugaucgacaacgaguucacggagguggagaagcagaucggcaacgugaucaacuggacccgggacagcaugaccgaggucugguccuacaacgcggagcuccugguggccauggagaaccagcacaccaucgaccuggccgacagcgagaugaacaagcucuacgagcgcgugaagcgccagcugcgggagaacgccgaggaggacgggacgggcugcuucgagaucuuccacaagugcgacgacgacugcauggccuccauccgcaacaacaccuacgaccacagcaaguaccgggaggaggcgaugcagaaccgcauccagaucgaccccgucaagcuguccagcggguacaaggacgugauccucugguucuccuucggcgccagcugcuucauccugcuggccaucgccauggggcucgucuucaucugcgugaagaacggcaacaugcggugcaccaucugcaucuga

SEQ ID NO: 71225 - RNA, 1683 nt, Artificial Sequence
  derived and/or modified sequence opt1 from hemagglutinin__InfluenzaA__AGQ81001
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccaacaucccgcgcaucugcuccaaggggaagcggaccguggaccucggccagugcgggcugcugggcaccaucacgggcccgccccagugcgaccaguuccucgaguucagcgccgaccugaucaucgagcgccgggagggguccgacgugugcuaccccggcaaguucgucaacgaggaggcccugcgccagauccuccgggagagcgggggcaucgacaaggagaccaugggguucaccuacuccggcauccgcaccaacggcgcgacgagcgccugccggcgcuccgggagcuccuucuacgccgagaugaaguggcugcugagcaacaccgacaacgccgcguucccccagaugaccaaguccuacaagaacacccggaaggaccccgcccucaucaucuggggcauccaccacagcggguccacgaccgagcagaccaagcuguacggcagcggcaacaagcugaucaccguggggacguccaacuaccagcagagcuucgugcccucccccggcgcccgcccgcaggucaacgggcagagcggccggaucgacuuccacuggcucaugcugaaccccaacgacaccgugaccuucuccuucaacggggccuucaucgcccccgaccgcgcgagcuuccugcggggcaagagcaugggcauccaguccggggugcaggucgacgccaacugcgagggcgacugcuaccacaacgggggcaccaucaucagcaaccuccccuuccagaacaucaacucccgcgccguggggaagugcccgcgguacgugaagcaggagagccugcugcucgccacgggcaugaagaacguccccgagauccccaagggccgcgggcuguucggcgccaucgcgggguucaucgagaacggcugggaggggcugaucgacggcugguacggcuuccggcaccagaacgcccagggggagggcaccgccgccgacuacaaguccacccagagcgccaucgaccagaucaccgggaagcucaaccgccugaucgagaagacgaaccagcaguucgagcugaucgacaacgaguucaccgagaucgagaagcagaucggcaacgugaucaacuggacccgggacuccaugaccgagguguggagcuacaacgcggagcuccuggucgccauggagaaccagcacacgaucgaccuggccgacuccgagaugaacaagcucuacgagcgcgugaagcgccagcugcgggagaacgccgaggaggacggcaccgggugcuucgagaucuuccacaagugcgacgacgacugcauggccagcauccgcaacaacaccuacgaccacuccaaguaccgggaggaggcgaugcagaaccgcauccagaucgaccccgugaagcugagcuccggcuacaaggacgucauccucugguucagcuucggggccuccugcuucauccugcuggccaucgccaugggccucguguucaucugcgucaagaacgggaacaugcggugcaccaucugcaucuga

SEQ ID NO: 71226 - RNA, 1683 nt, Artificial Sequence; identical to SEQ ID NO: 71203
  derived and/or modified sequence opt1 from hemagglutinin__InfluenzaA__AGQ81002

SEQ ID NO: 71227 - RNA, 1683 nt, Artificial Sequence; identical to SEQ ID NO: 71203
  derived and/or modified sequence opt1 from hemagglutinin__InfluenzaA__AGQ81003

SEQ ID NO: 71228 - RNA, 1683 nt, Artificial Sequence; identical to SEQ ID NO: 71203
  derived and/or modified sequence opt1 from hemagglutinin__InfluenzaA__AGQ81004

SEQ ID NO: 71229 - RNA, 1683 nt, Artificial Sequence; identical to SEQ ID NO: 71203
  derived and/or modified sequence opt1 from hemagglutinin__InfluenzaA__AGQ81005

SEQ ID NO: 71230 - RNA, 1683 nt, Artificial Sequence; identical to SEQ ID NO: 71203
  derived and/or modified sequence opt1 from hemagglutinin__InfluenzaA__AGQ81006

SEQ ID NO: 71231 - RNA, 1683 nt, Artificial Sequence; identical to SEQ ID NO: 71203
  derived and/or modified sequence opt1 from hemagglutinin__InfluenzaA__AGQ81007

SEQ ID NO: 71232 - RNA, 1683 nt, Artificial Sequence; identical to SEQ ID NO: 71203
  derived and/or modified sequence opt1 from hemagglutinin__InfluenzaA__AGQ81008

SEQ ID NO: 71233 - RNA, 1683 nt, Artificial Sequence
  derived and/or modified sequence opt1 from hemagglutinin__InfluenzaA__AGQ81009
augaacacccagauccugguguucgcccucgucgccaucauccccaccaacgcggacaagaucugccugggccaccacgccgugagcaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugcgaccaguuccucgaguucuccgccgaccugaucaucgagcgccaggaggggagcgacgugugcuaccccggcaaguucgucaacgaggaggcgcugcggcagauccuccgcgaguccgggggcaucaacaaggagacgaugggguucaccuacagcggcauccggaccaacggcgccaccuccgccugccgccggagcggguccagcuucuacgccgagaugaaguggcugcuguccaacacggacaacgcggccuucccccagaccaccaagagcuacaagaacacccgcaaggaccccgcccucaucaucuggggcauccaccacuccgggagcacgaccgagcagaccaagcuguacggcuccggcaacaagcugaucaccguggggagcuccaacuaccagcagagcuucgugcccucccccggcgcccggccgcaggucaacgggcagagcggccgcaucgacuuccacuggcucaugcugaaccccaacgacacggugaccuucagcuucaacggggccuucaucgcgcccgaccgggccuccuuccugcgcggcaagagcaugggcauccaguccggggugcaggucgacgccaacugcgagggcgacugcuaccacaacgggggcaccaucaucagcaaccuccccuuccagaacaucaacucccgggccguggggaagugcccgcgcuacgugaagcaggagagccugcugcucgccaccggcaugaagaacguccccgagauccccaagggccgggggcuguucggcgcgaucgccggguucaucgagaacggcugggaggggcugguggacggcugguacggcuuccgccaccagaacgcccagggggagggcacggccgccgacuacaaguccacccagagcgcgaucgaccagaucaccgggaagcucaaccggcugaucgagaagaccaaccagcaguucgagcugaucgacaacgaguucacggagguggagcgccagaucggcaacgucaucaacuggacccgggacuccaugaccgagguguggagcuacaacgccgagcuccugguggccauggagaaccagcacaccaucgaccuggccgacuccgagaugaacaagcucuacgagcgcguccgccggcagcugcgcgagaacgccgaggaggacggcacggggugcuucgagaucuuccacaagugcgacgacgacugcauggcgagcauccggaacaacaccuacgaccacuccaaguaccgcgaggaggccaugcagaaccggauccagaucgaccccgugaagcugagcuccggcuacaaggacgucauccucugguucagcuucggggccuccugcuucauccugcuggccaucgcgaugggccucguguucaucugcgugaagaacgggaacaugcgcugcaccaucugcaucuga

SEQ ID NO: 71234 - RNA, 1683 nt, Artificial Sequence
  derived and/or modified sequence opt1 from hemagglutinin__InfluenzaA__AGQ81011
augaacacccagauccugguguucgcccucaucgccaucacccccacgaacagcgacaagaucugccugggccaccacgcggucuccaacgggaccaaggugaacacccugaccgagcgcggcguggaggucgugaacgccacggagaccguggagcggaccagcaucccgcgcaucugcuccaaggggaagcggaccgucgaccucggccagugcgggcugcugggcacgaucaccggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggccaugggguucaccuacuccggcauccgcaccaacggcgcgacgagcgccugccggcgcuccgagagcuccuucuacgccgagaugaaguggcugcugagcaacaccgacaacgccgcguucccgcccaugaccaaguccuacaagaacacccggaaggcccccgcccucaucaucugggggauccaccacagcggcuccacggccgagcagaccaagcuguacgggagcggcaacaagcuggucaccgugcgcuccagcaacuaccagcaguccuucgugcccagccccggcgccgggcccaaggucaacggccagagcgggcggaucgacuuccacuggcucaugcugaaccccaacgacaccgugacguucuccuucaacggcgcguucaucgcccccgaccgcgccagcuuccugcgggggaaguccaugggcauccagagcggcgugcaggucgacgccaacugcgagggggacugcuaccacuccggcgggaccaucaucagcaaccucccguuccagaacaucgacucccgcguggugggcaagugcccccgguacgucaagcagaagucccugcugcucgccaccgggaugaagaacgugcccgagauccccaagggccgcggccuguucggggcgaucgccggcuucaucgagaacgggugggagggccugaucgacgggugguacggcuuccggcaccagaacgcccagggcgaggggaccgccgccgacuacaagagcacgcagagcgcgaucaaccagaugaccggcaagcucaaccgccugaucgagaagaccaaccagcaguucgagcugaucgacaacgaguucaccgagguggagaagcagaucgggaacgucaucaacuggacgcgggacuccaucaccgagguguggagcuacaacgccgagcuccugguggccauggagaaccagcacaccaucgaccuggccgacuccgagaugaacaagcucuacgagcgcgucaagcgccagcugcgggagaacgccgaggaggacggcaccggcugcuucgagaucuuccacaagugcgacgacgacugcauggcgagcauccgcaacaacacguacgaccacuccaaguaccgggaggaggccaugcagaaccgcauccagaucgacccggugaagcugagcuccggguacaaggacgucauccucugguucagcuucggcgccuccugccugauccugcucgccaucgcgauggggcugguguucaucugcgugaagaacggcaacaugcggugcaccaucugcaucuga

SEQ ID NO: 71235 - RNA, 1683 nt, Artificial Sequence
  derived and/or modified sequence opt1 from hemagglutinin__InfluenzaA__AGQ81012
augaacacccagauccugguguucgcccucaucgccaucauccccaccaacagcgacaagaucugccugggccaccacgcggucuccaacgggacgaaggugaacacccugaccgagcgcggcguggaggucgugaacgccaccgagacgguggagcggaccagcaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucaacaaggaggccaugggguucaccuacuccggcauccgcaccaacggcgcgaccagcgccugccggcgcuccgggagcuccuucuacgccgagaugaaguggcugcugagcaacacggacaacgccgcguucccgcccaugaccaaguccuacaagaacacccggaaggcccccgcccucaucaucuggggcauccaccacagcggguccaccgccgagcagacgaagcuguacggcagcggcaacaagcuggucaccgugcgcuccagcaacuaccagcaguccuucgugcccagccccggggccggcccccaggucaacgggcagagcggccggaucgacuuccacuggcucaugcugaaccccaacgacaccgugaccuucuccuucaacggggcguucaucgcccccgaccgcgccagcuuccugcggggcaaguccaugggcauccagagcggggugcaggucgacgccaacugcgagggcgacugcuaccacuccgggggcacgaucaucagcaaccucccguuccagaacaucgacucccgcgugguggggaagugcccccgguacgucaagcagaagucccugcugcucgccaccggcaugaagaacgugcccgagauccccaagggccgcgggcuguucggcgcgaucgccggguucaucgagaacggcugggaggggcugaucgacggcugguacggcuuccggcaccagaacgcccagggggagggcaccgccgccgacuacaagagcacccagagcgcgaucaaccagaugacggggaagcucaaccgccugaucgagaagaccaaccagcaguucgagcugaucgacaacgaguucaccgagguggagaagcagaucggcaacgucaucaacuggacccgggacuccaucacggagguguggagcuacaacgccgagcuccugguggccauggagaaccagcacaccaucgaccuggccgacuccgagaugaacaagcucuacgagcgcgucaagcgccagcugcgggagaacgccgaggaggacggcaccgggugcuucgagaucuuccacaagugcgacgacgacugcauggcgagcauccgcaacaacaccuacgaccacuccaaguaccgggaggaggccaugcagaaccgcauccagaucgacccggugaagcugagcuccggcuacaaggacgucauccucugguucagcuucggggccuccugcuucauccugcuggccaucgcgaugggccucguguucaucugcgugaagaacgggaacaugcggugcacgaucugcaucuga

SEQ ID NO: 71236 - RNA, 1683 nt, Artificial Sequence
  derived and/or modified sequence opt1 from hemagglutinin__InfluenzaA__AGQ81017
augaacacccagauccugguguucgcccucaucgccaucacccccacgaacagcgacaagaucugccugggccaccacgcggucuccaacgggaccaaggugaacacccugaccgagcgcggcguggaggucgugaacgccacggagaccguggagcggaccagcaucccgcgcaucugcuccaaggggaagcggaccgucgaccucggccagugcgggcugcugggcacgaucaccggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggccaugggguucaccuacuccggcauccgcaccaacggcgcgacgagcgccugccggcgcuccgggagcuccuucuacgccgagaugaaguggcugcugagcaacaccgacaacgccgcguucccgcccaugaccaaguccuacaagaacacccggaaggcccccgcccucaucaucuggggcauccaccacagcggguccacggccgagcagaccaagcuguacggcagcggcaacaagcuggucaccgugcgcuccagcaacuaccagcaguccuucgugcccagccccggggccggcccccaggucaacgggcagagcggccggaucgacuuccacuggcucaugcugaaccccaacgacaccgugacguucuccuucaacggggcguucaucgcccccgaccgcgccagcuuccugcggggcaaguccaugggcauccagagcggggugcaggucgacgccaacugcgagggcgacugcuaccacuccgggggcaccaucaucagcaaccucccguuccagaacaucgacucccgcgugguggggaagugcccccgguacgucaagcagaagucccugcugcucgccaccggcaugaagaacgugcccgagauccccaagggccgcgggcuguucggcgcgaucgccggguucaucgagaacggcugggaggggcugaucgacggcugguacggcuuccggcaccagaacgcccagggggagggcaccgccgccgacuacaagagcacgcagagcgcgaucaaccagaugaccgggaagcucaaccgccugaucgagaagaccaaccagcaguucgagcugaucgacaacgaguucaccgagguggagaagcagaucggcaacgucaucaacuggacgcgggacuccaucaccgagguguggagcuacaacgccgagcuccugguggccauggagaaccagcacaccaucgaccuggccgacuccgagaugaacaagcucuacgagcgcgucaagcgccagcugcgggagaacgccgaggaggacggcaccgggugcuucgagaucuuccacaagugcgacgacgacugcauggcgagcauccgcaacaacacguacgaccacuccaaguaccgggaggaggccaugcagaaccgcauccagaucgacccggugaagcugagcuccggcuacaaggacgucauccucugguucagcuucggggccuccugcuucauccugcuggccaucgcgaugggccucguguucaucugcgugaagaacgggaacaugcggugcaccaucugcaucuga

SEQ ID NO: 71237 - RNA, 1683 nt, Artificial Sequence
  derived and/or modified sequence opt1 from hemagglutinin__InfluenzaA__AGQ81018
augaacacccagauccugguguucgcccucaucgccaucauccccaccaacagcgacaagaucugccugggccaccacgcggucuccaacgggacgaaggugaacacccugaccgagcgcggcguggaggucgugaacgccaccgagacgguggagcggaccagcaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgucaaggaggccaugggguucaccuacuccggcauccgcaccaacggcgcgaccagcgccugccggcgcuccgggagcuccuucuacgccgagaugaaguggcugcugagcaacacggacaacgccgcguucccgcccaugaccaaguccuacaagaacacccggaaggcccccgccaucaucaucuggggcauccaccacagcggguccaccgccgagcagacgaagcucuacggcagcggcaacaagcuggugaccgugcgcuccagcaacuaccagcaguccuucguccccagccccggggccggcccccaggugaacgggcagagcggccggaucgacuuccacuggcugaugcucaaccccaacgacaccgugaccuucuccuucaacggggcguucaucgcccccgaccgcgccagcuuccugcggggcaaguccaugggcauccagagcgggguccagguggacgccaacugcgagggcgacugcuaccacucccgcgggacgaucaucagcaaccugccguuccagaacaucgacucccggguggucggcaagugcccccgcuacgugaagcagaagucccuccugcuggccaccgggaugaagaacgugcccgagauccccaagggccggggccucuucggggcgaucgccggcuucaucgagaacgggugggagggccugaucgacgggugguacggcuuccgccaccagaacgcccagggcgaggggaccgccgccgacuacaagagcacccagagcgcgaucaaccagaugacgggcaagcugaaccggcucaucgagaagaccaaccagcaguucgagcugaucgacaacgaguucaccgaggucgagaagcagaucgggaacgugaucaacuggacccgcgacuccaucacggagguguggagcuacaacgccgagcugcucgucgccauggagaaccagcacaccaucgaccuggccgacuccgagaugaacaagcuguacgagcgcgugaagcggcagcuccgcgagaacgccgaggaggacggcaccggcugcuucgagaucuuccacaagugcgacgacgacugcauggcgagcauccggaacaacaccuacgaccacuccaaguaccgcgaggaggccaugcagaaccggauccagaucgacccggucaagcugagcuccggguacaaggacgugauccugugguucagcuucggcgccuccugcuucauccuccuggccaucgcgauggggcugguguucaucugcgucaagaacggcaacaugcgcugcacgaucugcaucuga

SEQ ID NO: 71238 - RNA, 1683 nt, Artificial Sequence; identical to SEQ ID NO: 71237
  derived and/or modified sequence opt1 from hemagglutinin__InfluenzaA__AGQ81019

SEQ ID NO: 71239 - RNA, 1683 nt, Artificial Sequence; identical to SEQ ID NO: 71236
  derived and/or modified sequence opt1 from hemagglutinin__InfluenzaA__AGQ81020

SEQ ID NO: 71240 - RNA, 1683 nt, Artificial Sequence; identical to SEQ ID NO: 71237
  derived and/or modified sequence opt1 from hemagglutinin__InfluenzaA__AGQ81021

SEQ ID NO: 71241 - RNA, 1683 nt, Artificial Sequence; identical to SEQ ID NO: 71236
  derived and/or modified sequence opt1 from hemagglutinin__InfluenzaA__AGQ81022

SEQ ID NO: 71242 - RNA, 1683 nt, Artificial Sequence; identical to SEQ ID NO: 71237
  derived and/or modified sequence opt1 from hemagglutinin__InfluenzaA__AGQ81023

SEQ ID NO: 71243 - RNA, 1683 nt, Artificial Sequence
  derived and/or modified sequence opt1 from hemagglutinin__InfluenzaA__AGQ81025
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucgacaaggaggcgaugggguucaccuacagcggcauccgcaccaacggcgucaccuccgccugccggcgcagcggguccagcuucuacgccgagaugaaguggcugcuguccaacacggacaacgccgcguucccgcccaugaccaagagcuacaagaacacccggaaggcccccgcccucaucaucuggggcauccaccacuccgggagcaccgccgagcagacgaagcuguacggcuccggcaacaagcuggugaccgugcgcagcuccaacuaccagcagagcuucguccccucccccggggccggcccccaggugaacgggcagagcggccggaucgacuuccacuggcucaugcugaaccccaacgacaccgugaccuucagcuucaacggggcguucaucgcccccgaccgcgccuccuuccugcggggcaagagcaugggcauccaguccgggguccagguggacgccaacugcgagggcgacugcuaccacagcgggggcacgaucaucuccaaccucccguuccagaacaucgacagccgcguggucgggaagugcccccgguacgugaagcagaagucccugcugcucgccaccggcaugaagaacgugcccgagauccccaagggccgcgggcuguucggcgcgaucgccggguucaucgagaacggcugggaggggcugaucgacggcugguacggcuuccggcaccagaacgcccagggggagggcaccgccgccgacuacaagagcacccaguccgcgaucaaccagaugacggggaagcucaaccgccugaucgagaagaccaaccagcaguucggccugaucgacaacgaguucaccgaggucgagaagcagaucggcaacgugaucaacuggacccgggacagcaucacggaggugugguccuacaacgccgagcuccuggucgccauggagaaccagcacaccaucgaccuggccgacagcgagaugaacaagcucuacgagcgcgugaagcgccagcugcgggagaacgccgaggaggacgggaccggcugcuucgagaucuuccacaagugcgacgacgacugcauggcguccauccgcaacaacaccuacgaccacagcaaguaccgggaggaggccaugcagaaccgcauccagaucgacccggucaagcuguccagcggguacaaggacgugauccucugguucuccuucggcgccagcugcuucauccugcuggccaucgcgauggggcucguggucaucugcgugaagaacggcaacaugcggugcacgaucugcaucuga

SEQ ID NO: 71244 - RNA, 1683 nt, Artificial Sequence
  derived and/or modified sequence opt1 from hemagglutinin__InfluenzaA__AGQ81026
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucgacaaggaggcgaugggguucaccuacagcggcauccgcaccaacggcgccaccuccgccugccggcgcagcggguccagcuucuacgccgagaugaaguggcugcuguccaacacggacaacgcggccuucccgcccaccaccaagagcuacaagaacacccggaaggcccccgcccucaucaucuggggcauccaccacuccgggagcacggccgagcagaccaagcuguacggcuccggcaacaagcuggucaccgugcgcagcuccaacuaccagcagagcuucgugcccucccccggggcgggcccccaggucaacgggcagagcggccggaucgacuuccacuggcucaugcugaaccccaacgacaccgugacguucagcuucaacggggccuucaucgcccccgaccgcgccuccuuccugcggggcaagagcaugggcauccaguccggggugcaggucgacgccaacugcgagggcgacugcuaccacagcgggggcaccaucaucuccaaccucccguuccagaacaucgacagccgcgugguggggaagugcccccgguacgucaagcagaagucccugcugcucgcgaccggcaugaagaacgugcccgagauccccaagggccgcgggcuguucggcgccaucgccggguucaucgagaacggcugggaggggcugaucgacggcugguacggcuuccggcaccagaacgcccagggggagggcaccgccgcggacuacaagagcacgcaguccgccaucaaccagaugaccgggaagcucaaccgccugaucgagaagaccaaccagcaguucgagcugaucgacaacgaguucaccgagguggagaagcagaucggcaacgucaucaacuggacgcgggacagcaucaccgaggugugguccuacaacgccgagcuccugguggccauggagaaccagcacaccaucgaccuggccgacagcgagaugaacaagcucuacgagcgcgucaagcgccagcugcgggagaacgcggaggaggacggcaccgggugcuucgagaucuuccacaagugcgacgacgacugcauggccuccauccgcaacaacacguacgaccacagcaaguaccgggaggaggccaugcagaaccgcauccagaucgacccggugaagcuguccagcggcuacaaggacgucauccucugguucuccuucggggccagcugcuucauccugcuggcgaucgccaugggccucguguucaucugcgugaagaacgggaacaugcggugcaccaucugcaucuga

SEQ ID NO: 71245 - RNA, 1683 nt, Artificial Sequence
  derived and/or modified sequence opt1 from hemagglutinin__InfluenzaA__AGQ81027
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucgacaaggaggcgaugggguucaccuacagcggcauccgcaccaacggcgucaccuccgccugccggcgcagcggguccagcuucuacgccgagaugaaguggcugcuguccaacacggacaacgccgcguucccgcccaugaccaagagcuacaagaacacccggaaggcccccgcccucaucaucuggggcauccaccacuccgggagcaccgccgagcagacgaagcuguacggcuccggcaacaagcuggugaccgugcgcagcuccaacuaccagcagagcuucguccccucccccggggccggcccccaggugaacgggcagagcggccggaucgacuuccacuggcucaugcugaaccccaacgacaccgugaccuucagcuucaacggggcguucaucgcccccgaccgcgccuccuuccugcggggcaagagcaugggcauccaguccgggguccagguggacgccaacugcgagggcgacugcuaccacagcgggggcacgaucaucuccaaccucccguuccagaacaucgacagccgcguggucgggaagugcccccgguacgugaagcagaagucccugcugcucgccaccggcaugaagaacgugcccgagauccccaagggccgcgggcuguucggcgcgaucgccggguucaucgagaacggcugggaggggcugaucgacggcugguacggcuuccggcaccagaacgcccagggggagggcaccgccgccgacuacaagagcacccaguccgcgaucaaccagaugacggggaagcucaaccgccugaucgagaagaccaaccagcaguucgagcugaucgacaacgaguucaccgaggucgagaagcagaucggcaacgugaucaacuggacccgggacagcaucacggaggugugguccuacaacgccgagcuccuggucgccauggagaaccagcacaccaucgaccuggccgacagcgagaugaacaagcucuacgagcgcgugaagcgccagcugcgggagaacgccgaggaggacggcaccgggugcuucgagaucuuccacaagugcgacgacgacugcauggcguccauccgcaacaacaccuacgaccacagcaaguaccgggaggaggccaugcagaaccgcauccagaucgacccggucaagcuguccagcggcuacaaggacgugauccucugguucuccuucggggccagcugcuucauccugcuggccaucgcgaugggccucguguucaucugcgucaagaacgggaacaugcggugcacgaucugcaucuga

SEQ ID NO: 71246 - RNA, 1683 nt, Artificial Sequence
  derived and/or modified sequence opt1 from hemagglutinin__InfluenzaA__AGQ81028
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucgacaaggaggcgaugggguucaccuacagcggcauccgcaccaacggcgccaccuccgccugccggcgcagcggguccagcuucuacgccgagaugaaguggcugcuguccaacacggacaacgcggccuucccgcccaccaccaagagcuacaagaacacccggaaggcccccgcccucaucaucuggggcauccaccacuccgggagcacggccgagcagaccaagcuguacggcuccggcaacaagcuggucaccgugcgcagcuccaacuaccagcagagcuucgugcccucccccggggcgggcccccaggucaacgggcagagcggccggaucgacuuccacuggcucaugcugaaccccaacgacaccgugacguucagcuucaacggggccuucaucgcccccgaccgcgccuccuuccugcggggcaagagcaugggcauccaguccggggugcaggucgacgccaacugcgagggcgacugcuaccacagcgggggcaccaucaucuccaaccucccguuccagaacaucgacagccgcgugguggggaagugcccccgguacgucaagcagaagucccugcugcucgcgaccggcaugaagaacgugcccgagauccccaagggccgcgggcuguucggcgccaucgccggguucaucgagaacggcugggaggggcugaucgacggcugguacggcuuccggcaccagaacgcccagggggagggcaccgccgcggacuacaagagcacgcaguccgccaucaaccagaugaccgggaagcucaaccgccugaucgagaagaccaaccagcaguucgagcugaucgacaacgaguucaccgagguggagaagcagaucggcaacgucaucaacuggacgcgggacagcaucaccgagaugugguccuacaacgccgagcuccugguggccauggagaaccagcacaccaucgaccuggccgacagcgagaugaacaagcucuacgagcgcgugaagcgccagcugcgggagaacgcggaggaggacggcaccgggugcuucgagaucuuccacaagugcgacgacgacugcauggccuccauccgcaacaacacguacgaccacagcaaguaccgggaggaggccaugcagaaccgcauccagaucgacccggucaagcuguccagcggcuacaaggacgugauccucugguucuccuucggggccagcugcuucauccugcuggcgaucgccaugggccucgucuucaucugcgugaagaacgggaacaugcggugcaccaucugcaucuga

SEQ ID NO: 71247 - RNA, 1683 nt, Artificial Sequence
  derived and/or modified sequence opt1 from hemagglutinin__InfluenzaA__AGQ81029
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucgacaaggaggcgaugggguucaccuacagcggcauccgcaccaacggcgucaccuccgccugccggcgcagcggguccagcuucuacgccgagaugaaguggcugcuguccaacacggacaacgccgcguucccgcccaugaccaagagcuacaagaacacccggaaggcccccgcccucaucaucuggggcauccaccacuccgggagcaccgccgagcagacgaagcuguacggcuccggcaacaagcuggugaccgugcgcagcuccaacuaccagcagagcuucaugcccucccccggggccggcccccaggucaacgggcagagcggccggaucgacuuccacuggcucaugcugaaccccaacgacaccgugaccuucagcuucaacggggcguucaucgcccccgaccgcgccuccuuccugcggggcaagagcaugggcauccaguccggggugcaggucgacgccaacugcgagggcgacugcuaccacagcgggggcacgaucaucuccaaccucccguuccagaacaucgacagccgcgugguggggaagugcccccgguacgucaagcagaagucccugcugcucgccaccggcaugaagaacgugcccgagauccccaagggccgcgggcuguucggcgcgaucgccggguucaucgagaacggcugggaggggcugaucgacggcugguacggcuuccggcaccagaacgcccagggggagggcaccgccgccgacuacaagagcacccaguccgcgaucaaccagaugacggggaagcucaaccgccugaucgagaagaccaaccagcaguucgagcugaucgacaacgaguucaccgagguggagaagcagaucggcaacgucaucaacuggacccgggacagcaucacggaggugugguccuacaacgccgagcuccugguggccauggagaaccagcacaccaucgaccuggccgacagcgagaugaacaagcucuacgagcgcgucaagcgccagcugcgggagaacgccgaggaggacggcaccgggugcuucgagaucuuccacaagugcgacgacgacugcauggcguccauccgcaacaacaccuacgaccacagcaaguaccgggaggaggccaugcagaaccgcauccagaucgacccggugaagcuguccagcggcuacaaggacgucauccucugguucuccuucggggccagcugcuucauccugcuggccaucgcgaugggccucguguucaucugcgugaagaacgggaacaugcggugcacgaucugcaucuga

SEQ ID NO: 71248 - RNA, 1683 nt, Artificial Sequence
  derived and/or modified sequence opt1 from hemagglutinin__InfluenzaA__AGQ81031
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucaacaaggaggcgaugggguucaccuacagcggcauccgcaccaacggcgccaccuccgccugccggcgcagcggguccagcuucuacgccgagaugaaguggcugcuguccaacacggacaacgcggccuucccgcccaugaccaagagcuacaagaacacccggaaggcccccgcccucaucaucuggggcauccaccacuccgggagcaccgccgagcagacgaagcuguacggcuccggcaacaagauggucaccgugcgcagcuccaacuaccagcagagcuucgugcccucccccggggcgggcccccaggucaacgggcagagcggccggaucgacuuccacuggcugaugcucaaccccaacgacaccgugaccuucagcuucaacggggccuucaucgcccccgaccgcgccuccuuccugcggggcaagagcaugggcauccaguccggggugcaggucgacgccaacugcgagggcgacugcuaccacagcgggggcacgaucaucuccaaccugccguuccagaacaucgacagccgcgugguggggaagugcccccgguacgucaagcagaagucccuccugcuggcgaccggcaugaagaacgugcccgagauccccaagggccgcggccucuucggggccaucgccggguucaucgagaacggcugggaggggcugaucgacggcugguacggcuuccggcaccagaacgcccagggggagggcaccgccgcggacuacaagagcacccaguccgccaucaaccagaugacggggaagcugaaccgccucaucgagaagaccaaccagcaguucgagcugaucgacaacgaguucaccgagguggagcggcagaucggcaacgucaucaacuggacccgcgacagcaucacggaggugugguccuacaacgccgagcugcucguggccauggagaaccagcacaccaucgaccuggccgacagcgagaugaacaagcuguacgagcgcgucaagcggcagcuccgcgagaacgcggaggaggacggcaccgggugcuucgagaucuuccacaagugcgacgacgacugcauggccuccauccggaacaacaccuacgaccacagcaaguaccgcgaggaggccaugcagaaccggauccagaucgacccggugaagcuguccagcggcuacaaggacgucauccugugguucuccuucggggccagcugcuucauccuccuggcgaucgccaugggccugguguucaucugcgugaagaacgggaacaugcgcugcacgaucugcaucuga

SEQ ID NO: 71249 - RNA, 1683 nt, Artificial Sequence; identical to SEQ ID NO: 71244
  derived and/or modified sequence opt1 from hemagglutinin__InfluenzaA__AGQ81032

SEQ ID NO: 71250 - RNA, 1683 nt, Artificial Sequence; identical to SEQ ID NO: 71245
  derived and/or modified sequence opt1 from hemagglutinin__InfluenzaA__AGQ81033

SEQ ID NO: 71251 - RNA, 1683 nt, Artificial Sequence; identical to SEQ ID NO: 71244
  derived and/or modified sequence opt1 from hemagglutinin__InfluenzaA__AGQ81034

SEQ ID NO: 71252 - RNA, 1683 nt, Artificial Sequence; identical to SEQ ID NO: 71245
  derived and/or modified sequence opt1 from hemagglutinin__InfluenzaA__AGQ81035

SEQ ID NO: 71253 - RNA, 1683 nt, Artificial Sequence; identical to SEQ ID NO: 71245
  derived and/or modified sequence opt1 from hemagglutinin__InfluenzaA__AGQ81036

SEQ ID NO: 71254 - RNA, 1683 nt, Artificial Sequence; identical to SEQ ID NO: 71245
  derived and/or modified sequence opt1 from hemagglutinin__InfluenzaA__AGQ81037

SEQ ID NO: 71255 - RNA, 1683 nt, Artificial Sequence; identical to SEQ ID NO: 71237
  derived and/or modified sequence opt1 from hemagglutinin__InfluenzaA__AGQ81038

SEQ ID NO: 71256 - RNA, 1683 nt, Artificial Sequence; identical to SEQ ID NO: 71237
  derived and/or modified sequence opt1 from hemagglutinin__InfluenzaA__AGQ81039

SEQ ID NO: 71257 - RNA, 1683 nt, Artificial Sequence
  derived and/or modified sequence opt1 from hemagglutinin__InfluenzaA__AGQ81040
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccccagaugaccaaguccuacaagaacacccggaaggaccccgcccucaucaucuggggcauccaccacagcggguccaccgccgagcagacgaagcuguacggcagcggcaacaagcuggucaccgugggguccagcaacuaccagcaguccuucgugcccagccccggcgcccgcccgcaggucaacgggcaguccggccggaucgacuuccacuggcucaugcugaaccccaacgacaccgugaccuucagcuucaacggggcguucaucgcccccgaccgcgccagcuuccugcggggcaaguccaugggcauccagagcggggugcagaucgacgccaacugcgagggcgacugcuaccacuccgggggcacgaucaucagcaaccuccccuuccagaacaucgacucccgcgccgucgggaagugcccgcgguacgugaagcagaagucccugcugcucgcgaccggcaugaagaacgugcccgagauccccaagggccgcgggcuguucggcgccaucgccggguucaucgagaacggcugggaggggcugaucgacggcugguacggcuuccggcaccagaacgcccagggggagggcaccgccgcggacuacaagagcacccagagcgccaucgaccagaucacggggaagcucaaccgccugaucgagaagaccaaccagcaguucgagcugaucgacaacgaguucaccgaggucgagaagcagaucggcaacgugaucaacuggacccgggacuccaucacggagguguggagcuacaacgccgagcuccuggucgccauggagaaccagcacaccaucgaccuggccgacuccgagaugaacaagcucuacgagcgcgugaagcgccagcugcgggagaacgcggaggaggacggcaccgggugcuucgagaucuuccacaagugcgacgacgacugcauggccagcauccgcaacaacaccuacgaccacuccaaguaccgggaggaggccaugcagaaccgcauccagaucgaccccgugaagcugagcuccggcuacaaggacgucauccucugguucagcuucggggccuccugcuucauccugcuggcgaucgccaugggccucguguucaucugcgucaagaacgggaacaugcggugcacgaucugcaucuga

SEQ ID NO: 71258 - RNA, 1683 nt, Artificial Sequence
  derived and/or modified sequence opt1 from hemagglutinin__InfluenzaA__AGQ81041
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccccagaccaccaaguccuacaagaacacccggaaggaccccgcccucaucaucuggggcauccaccacagcggguccacggccgagcagaccaagcuguacggcagcggcaacaagcuggucaccgugggguccagcaacuaccagcaguccuucgugcccagccccggcgcccgcccgcaggucaacgggcaguccggccggaucgacuuccacuggcucaugcugaaccccaacgacaccgugacguucagcuucaacggggcguucaucgcccccgaccgcgccagcuuccugcggggcaaguccaugggcauccagagcggggugcaggucgacgccaacugcgagggcgacugcuaccacuccgggggcaccaucaucagcaaccuccccuuccagaacaucgacucccgcgccguggggaagugcccgcgguacgugaagcagaagucccugcugcucgcgaccggcaugaagaacguccccgagauccccaagggccgcgggcuguucggcgccaucgccggguucaucgagaacggcugggaggggcugaucgacggcugguacggcuuccggcaccagaacgcccagggggagggcaccgccgcggacuacaagagcacgcagagcgccaucgaccagaucaccgggaagcucaaccgccugaucgagaagaccaaccagcaguucgagcugaucgacaacgaguucaccgagguggagaagcagaucggcaacgugaucaacuggacgcgggacuccaucaccgaggucuggagcuacaacgccgagcuccugguggccauggagaaccagcacaccaucgaccuggccgacuccgagaugaacaagcucuacgagcgcgugaagcgccagcugcgggagaacgcggaggaggacggcaccgggugcuucgagaucuuccacaagugcgacgacgacugcauggccagcauccgcaacaacacguacgaccacuccaaguaccgggaggaggccaugcagaaccgcauccagaucgaccccgucaagcugagcuccggcuacaaggacgugauccucugguucagcuucggggccuccugcuucauccugcuggcgaucgccaugggccucgucuucaucugcgugaagaacgggaacaugcggugcaccaucugcaucuga

SEQ ID NO: 71259 - RNA, 1683 nt, Artificial Sequence
  derived and/or modified sequence opt1 from hemagglutinin__InfluenzaA__AGQ81042
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggcgaugggguucaccuacuccggcauccgcaccaacggcgccaccagcgccugccggcgcuccgggagcuccuucuacgccgagaugaaguggcugcugagcaacacggacaacgcggccuucccccagaugaccaaguccuacaagaacacccggaaggaccccgcccucaucaucuggggcauccaccacagcggguccaccgccgagcagacgaagcuguacggcagcggcaacaagcuggucaccgugggguccagcaacuaccagcaguccuucgugcccagccccggcgcccgcccgcaggucaacgggcaguccggccggaucgacuuccacuggcucaugcugaaccccaacgacaccgugaccuucagcuucaacggggcguucaucgcccccgaccgcgccagcuuccugcggggcaaguccaugggcauccagagcggggugcaggucgacgccaacugcgagggcgacugcuaccacuccgggggcacgaucaucagcaaccuccccuuccagaacaucgacucccgcgccguggggaagugcccgcgguacgugaagcagaagucccugcugcucgcgaccggcaugaagaacguccccgagauccccaagggccgcgggcuguucggcgccaucgccggguucaucgagaacggcugggaggggcugaucgacggcugguacggcuuccggcaccagaacgcccagggggagggcaccgccgcggacuacaagagcacccagagcgccaucgaccagaucacggggaagcucaaccgccugaucgagaagaccaaccagcaguucgagcugaucgacaacgaguucaccgagguggagaagcagaucggcaacgugaucaacuggacccgggacuccaucacggaggucuggagcuacaacgccgagcuccugguggccauggagaaccagcacaccaucgaccuggccgacuccgagaugaacaagcucuacgagcgcgugaagcgccagcugcgggagaacgcggaggaggacggcaccgggugcuucgagaucuuccacaagugcgacgacgacugcauggccagcauccgcaacaacaccuacgaccacuccaaguaccgggaggaggccaugcagaaccgcauccagaucgaccccgucaagcugagcuccggcuacaaggacgugauccucugguucagcuucggggccuccugcuucauccugcuggcgaucgccaugggccucgucuucaucugcgugaagaacgggaacaugcggugcacgaucugcaucuga

SEQ ID NO: 71260 - RNA, 1683 nt, Artificial Sequence
  derived and/or modified sequence opt1 from hemagglutinin__InfluenzaA__AGQ81043
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggagaugggguucaccuacuccggcauccgcaccaacggcgcgaccagcgccugccggcgcuccgggagcuccuucuacgccgagaugaaguggcugcugagcaacacggacaacgccgcguucccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaacuaccagcagagcuucgugcccucccccggggcccggccccaggugaacggccucagcgggcggaucgacuuccacuggcugaugcugaaccccaacgacaccgucaccuucagcuucaacggcgccuucaucgcgcccgaccgcgccuccuuccuccggggcaagagcauggggauccaguccggcguccagguggacgccaacugcgagggggacugcuaccacagcggcgggacgaucaucuccaaccugcccuuccagaacaucgacagccgcgccgugggcaagugcccgcgguacgugaagcagcgcucccugcuccuggccaccgggaugaagaacgugcccgagauccccaagggccggggccuguucggggcgaucgccggcuucaucgagaacgggugggagggccucaucgacgggugguacggcuuccgccaccagaacgcccagggcgaggggaccgccgccgacuacaagagcacccaguccgcgaucgaccagaucacgggcaagcugaaccggcugaucgagaagaccaaccagcaguucgagcucaucgacaacgaguucaacgaggucgagaagcagaucgggaacgugaucaacuggacccgcgacagcaucaccgaggugugguccuacaacgccgagcugcuggucgccauggagaaccagcacacgaucgaccucgccgacagcgagauggacaagcuguacgagcgcgugaagcggcagcugcgcgagaacgccgaggaggacggcaccggcugcuucgagaucuuccacaagugcgacgacgacugcauggcguccauccggaacaacaccuacgaccacagcaaguaccgcgaggaggccaugcagaaccggauccagaucgaccccgucaagcucuccagcggguacaaggacgugauccugugguucuccuucggcgccagcugcuucauccugcucgccaucgugauggggcuggucuucaucugcgugaagaacggcaacaugcgcugcaccaucugcaucuga

SEQ ID NO: 71261 - RNA, 1683 nt, Artificial Sequence; identical to SEQ ID NO: 70996
  derived and/or modified sequence opt1 from hemagglutinin__InfluenzaA__AGQ81044

SEQ ID NO: 71262 - RNA, 1683 nt, Artificial Sequence; identical to SEQ ID NO: 70996
  derived and/or modified sequence opt1 from hemagglutinin__InfluenzaA__AGQ81045

SEQ ID NO: 71263 - RNA, 1683 nt, Artificial Sequence; identical to SEQ ID NO: 70996
  derived and/or modified sequence opt1 from hemagglutinin__InfluenzaA__AGQ81046

SEQ ID NO: 71264 - RNA, 1683 nt, Artificial Sequence; identical to SEQ ID NO: 71245
  derived and/or modified sequence opt1 from hemagglutinin__InfluenzaA__AGQ81047

SEQ ID NO: 71265 - RNA, 1683 nt, Artificial Sequence; identical to SEQ ID NO: 71244
  derived and/or modified sequence opt1 from hemagglutinin__InfluenzaA__AGQ81049

SEQ ID NO: 71266 - RNA, 1683 nt, Artificial Sequence; identical to SEQ ID NO: 71245
  derived and/or modified sequence opt1 from hemagglutinin__InfluenzaA__AGQ81050

SEQ ID NO: 71267 - RNA, 1683 nt, Artificial Sequence
  derived and/or modified sequence opt1 from hemagglutinin__InfluenzaA__AGQ81051
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucaacaaggaggcgaugggguucaccuacagcggcauccgcaccaacggcgccaccuccgccugccggcgcagcggguccagcuucuacgccgagaugaaguggcugcuguccaacacggacaacgcggccuucccgcccaugaccaagagcuacaagaacacccggaaggcccccgcccucaucaucuggggcauccaccacuccgggagcaccgccgagcagacgaagcuguacggcuccggcaacaagcuggucaccgugcgcagcuccaacuaccagcagagcuucgugcccucccccggggcgggcccccaggucaacgggcagagcggccggaucgacuuccacuggcucaugcugaaccccaacgacaccgugaccuucagcuucaacggggccuucaucgcccccgaccgcgccuccuuccugcggggcaagagcaugggcauccaguccggggugcaggucgacgccaacugcgagggcgacugcuaccacagcgggggcacgaucaucuccaaccucccguuccagaacaucgacagccgcgugguggggaagugcccccgguacgucaagcagaagucccugcugcucgcgaccggcaugaagaacgugcccgagauccccaagggccgcgggcuguucggcgccaucgccggguucaucgagaacggcugggaggggcugaucgacggcugguacggcuuccggcaccagaacgcccagggggagggcaccgccgcggacuacaagagcacccaguccgccaucaaccagaugacggggaagcucaaccgccugaucgagaagaccaaccagcaguucgagcugaucgacaacgaguucaccgagguggagaagcagaucggcaacgucaucaacuggacccgggacagcaucacggaggugugguccuacaacgccgagcuccugguggccauggagaaccagcacaccaucgaccuggccgacagcgagaugaacaagcucuacgagcgcgucaagcgccagcugcgggagaacgcggaggaggacggcaccgggugcuucgagaucuuccacaagugcgacgacgacugcauggccuccauccgcaacaacaccuacgaccacagcaaguaccgggaggaggccaugcagaaccgcauccagaucgacccggugaagcuguccagcggcuacaaggacgucauccucugguucuccuucggggccagcugcuucauccugcuggcgaucgccaugggccucguguucaucugcgugaagaacgggaacaugcggugcacgaucugcaucuga

SEQ ID NO: 71268 - RNA, 1683 nt, Artificial Sequence; identical to SEQ ID NO: 71245
  derived and/or modified sequence opt1 from hemagglutinin__InfluenzaA__AGQ81052

SEQ ID NO: 71269 - RNA, 1683 nt, Artificial Sequence
  derived and/or modified sequence opt1 from hemagglutinin__InfluenzaA__AGQ81053
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucaacaaggaggcgaugggguucaccuacagcggcauccgcaccaacggcgccaccuccgccugccggcgcagcggguccagcuucuacgccgagaugaaguggcugcuguccaacacggacaacgcggccuucccgcccaugaccaagagcuacaagaacacccggaaggcccccgcccucaucaucuggggcauccaccacuccgggagcaccgccgagcagacgaagcuguacggcuccggcaacaagauggucaccgugcgcagcuccaacuaccagcagagcuucgugcccucccccggggcgggcccccaggucaacgggcagagcggccggaucgacuuccacuggcugaugcucaaccccaacgacaccgugaccuucagcuucaacggggccuucaucgcccccgaccgcgccuccuuccugcggggcaagagcaugggcauccaguccggggugcaggucgacgccaacugcgagggcgacugcuaccacagcgggggcacgaucaucuccaaccugccguuccagaacaucgacagccgcgugguggggaagugcccccgguacgucaagcagaagucccuccugcuggcgaccggcaugaagaacgugcccgagauccccaagggccgcggccucuucggggccaucgccggguucaucgagaacggcugggaggggcugaucgacggcugguacggcuuccggcaccagaacgcccagggggagggcaccgccgcggacuacaagagcacccaguccgccaucaaccagaugacggggaagcugaaccgccucaucgagaagaccaaccagcaguucgagcugaucgacaacgaguucaccgagguggagaagcagaucggcaacgucaucaacuggacccgggacagcaucacggaggugugguccuacaacgccgagcugcucguggccauggagaaccagcacaccaucgaccuggccgacagcgagaugaacaagcuguacgagcgcgucaagcgccagcuccgggagaacgcggaggaggacggcaccgggugcuucgagaucuuccacaagugcgacgacgacugcauggccuccauccgcaacaacaccuacgaccacagcaaguaccggaaggaggccaugcagaaccgcauccagaucgacccggugaagcuguccagcggcuacaaggacgucauccugugguucuccuucggggccagcugcuucauccuccuggcgaucgccaugggccugguguucaucugcgugaagaacgggaacaugcggugcacgaucugcaucuga

SEQ ID NO: 71270 - RNA, 1683 nt, Artificial Sequence; identical to SEQ ID NO: 71245
  derived and/or modified sequence opt1 from hemagglutinin__InfluenzaA__AGQ81055

SEQ ID NO: 71271 - RNA, 1683 nt, Artificial Sequence; identical to SEQ ID NO: 71245
  derived and/or modified sequence opt1 from hemagglutinin__InfluenzaA__AGQ81056

SEQ ID NO: 71272 - RNA, 1683 nt, Artificial Sequence; identical to SEQ ID NO: 71245
  derived and/or modified sequence opt1 from hemagglutinin__InfluenzaA__AGQ81057

SEQ ID NO: 71273 - RNA, 1683 nt, Artificial Sequence; identical to SEQ ID NO: 71245
  derived and/or modified sequence opt1 from hemagglutinin__InfluenzaA__AGQ81058

SEQ ID NO: 71274 - RNA, 1683 nt, Artificial Sequence; identical to SEQ ID NO: 70996
  derived and/or modified sequence opt1 from hemagglutinin__InfluenzaA__AGQ81059

SEQ ID NO: 71275 - RNA, 1683 nt, Artificial Sequence; identical to SEQ ID NO: 70996
  derived and/or modified sequence opt1 from hemagglutinin__InfluenzaA__AGQ81060

SEQ ID NO: 71276 - RNA, 1683 nt, Artificial Sequence; identical to SEQ ID NO: 70996
  derived and/or modified sequence opt1 from hemagglutinin__InfluenzaA__AGQ81061

SEQ ID NO: 71277 - RNA, 1683 nt, Artificial Sequence
  derived and/or modified sequence opt1 from hemagglutinin__InfluenzaA__AGQ81081
auggagguggucagccugaucaccauccuccuggugaucaccggcuccaacgccgacaagaucugcaucggguaccagagcacgaacuccaccgagaccguggacacccugacggagaacaacguccccgugacccacgccaaggagcuccugcacaccgagcacaacggcaugcugugcgcgaccaaccucgggcgcccgcugauccuggacacgugcaccaucgagggccucaucuacgggaaccccagcugcgacauccugcugggcggccgggagugguccuacaucguggagcgccccagcgccgucaacgggcucugcuaccccggcaacguggagaaccuggaggagcugcggucccucuucagcuccgccagcuccuaccagcgcauccagaucuucccggacaccaucuggaacgugagcuacuccgggaccagcaaggccugcuccgacagcuucuaccgguccaugcgcuggcugacgcagaagaacaacgccuaccccguccaggacgcgcaguacaccaacaaccggggccgcaacauccuguucaugugggggaucaaccacccgcccaccgacaccgcccagacgaaccucuacacccggaccgacaccacgaccagcguggccaccgaggacaucaaccgcaccuucaagccccugaucggcccccggccccuggugaacggccuccaggggcgcaucgacuacuacugggccguccugcggcccggccagacgcugcgcauccgguccaacgggaaccucaucgcgccgugguacggccacauccugagcggcgagagccacgggcgcauccugaagaccgaccucaacuccggcaacugcguggugcagugccagaccgagcgcgggggccugaacaccacgcugcccuuccacaacgucagcaaguacgccuucgggaacugccccaaguacgugggcgugaagucccucaagcuggccgucggccugcggaacgugcccgcccggagcucccgcggccucuucggggccaucgcgggguucaucgagggcggguggagcggccugguggccggcugguacggguuccagcacuccaacgaccagggcaccgggauggccgccgaccgggacagcacccagaaggccaucgacaagaucaccuccaaggucaacaacaucguggacaagaugaacaagcaguacgagaucaucgaccacgaguucagcgagaucgagacgcgccugaacaugaucaacaacaagaucgacgaccagauccaggacaucugggcguacaacgccgagcuccuggugcugcucgagaaccagaagacccuggacgagcacgacgccaacgucaacaaccuguacaacaaggugaagcgcgcccucggcuccaacgccgucgaggacgggaagggcugcuucgagcuguaccacaagugcgacaaccagugcauggagaccauccggaacggcaccuacaaccgccggaaguacaaggaggagagccgccuggagcggcagaagaucgagggggugaagcucgaguccgagggcacguacaagauccugaccaucuacagcaccguggcguccagccuggucaucgccaugggguucgccgccuuccucuucugggccauguccaacggcagcugccgcugcaacaucugcaucuga

SEQ ID NO: 71278 - RNA, 1683 nt, Artificial Sequence
  derived and/or modified sequence opt1 from hemagglutinin__InfluenzaA__AGQ81086
auggagguggucagccugaucaccauccuccuggugaucaccggcuccaacgccgacaagaucugcaucggguaccagagcacgaacuccaccgagaccguggacacccugacggagaacaacguccccgugacccacgccaaggagcuccugcacaccgagcacaacggcaugcugugcgcgaccaaccucgggcgcccgcugauccuggacacgugcaccaucgagggccucaucuacgggaaccccagcugcgaccugcugcucggcggccgggagugguccuacaucguggagcgccccagcgccgucaacgggcugugcuaccccggcaacguggagaaccuggaggagcuccggucccuguucagcuccgccagcuccuaccagcgcauccagaucuucccggacaccaucuggaacgugagcuacuccgggaccagcaaggccugcuccgacagcuucuaccgguccaugcgcuggcugacgcagaagaacaacgccuaccccguccaggacgcgcaguacaccaacaaccggggccgcaacauccucuucaugugggggaucaaccacccgcccaccgacaccgcccagacgaaccuguacacccggaccgacaccacgaccagcguggccaccgaggacaucaaccgcaccuucaagccccugaucggcccccggccccucgugaacggccugcaggggcgcaucgacuacuacugggccguccugcggcccggccagacgcuccgcauccgguccaacgggaaccugaucgcgccgugguacggccacauccugagcggcgagagccacgggcgcauccucaagaccgaccugaacuccggcaacugcguggugcagugccagaccgagcgcgggggccugaacaccacgcuccccuuccacaacgucagcaaguacgccuucgggaacugccccaaguacgugggcgugaagucccugaagcuggccgucggccuccggaacgugcccgcccggagcucccgcgggcuguucggcgccaucgcgggguucaucgagggcggguggagcggccugguggccggcugguacggguuccagcacuccaacgaccagggcaccgggauggccgccgaccgggacagcacccagaaggccaucgacaagaucaccuccaaggucaacaacaucguggacaagaugaacaagcaguacgagaucaucgaccacgaguucagcgagaucgagacgcgccucaacaugaucaacaacaagaucgacgaccagauccaggacaucugggcguacaacgccgagcugcuggugcuccuggagaaccagaagacccuggacgagcacgacgccaacgucaacaaccucuacaacaaggugaagcgcgcccugggcuccaacgccgucgaggacgggaagggcugcuucgagcuguaccacaagugcgacaaccagugcauggagaccauccggaacggcaccuacaaccgccggaaguacaaggaggagagccgccucgagcggcagaagaucgagggggugaagcuggaguccgagggcacguacaagauccugaccaucuacagcaccguggcguccagccucgucaucgccaugggguucgccgccuuccuguucugggccauguccaacggcagcugccgcugcaacaucugcaucuga

SEQ ID NO: 71279 - RNA, 1683 nt, Artificial Sequence
  derived and/or modified sequence opt1 from hemagglutinin__InfluenzaA__AGQ81087
auggagaccgugagccugaucaccaugcuccuggucgccacggugaucaacgccgacaagaucugcaucggcuaccaguccaccaacagcaccgagaccguggacacgcugaccgagaacaacguccccgugacccacgcgaaggagcuccugcacaccgagcacaacgggaugcugugcgccacgaaccucggccacccgcugauccuggacacgugcaccaucgaggggcucaucuacggcaaccccuccugcgaccugcugcucgggggccgcgaguggagcuacaucguggagcggcccuccgccgucaacggccugugcuaccccgggaacguggagaaccuggaggagcuccgcagccuguucuccagcgccuccagcuaccagcggauccagaucuucccggacaccaucuggaacguguccuacagcggcaccuccaaggccugcagcgacuccuucuaccgcagcaugcgguggcugacccagaagaacaacgcguaccccauccaggacgcccaguacaccaacaaccgcgagaagaacauccucuucaugugggggaucaaccacccgcccaccgacacggcccagaccaaccuguacacccggaccgacacgaccaccuccgucgccaccgaggagaucaaccgcacguucaagccccugaucggcccccggccccucgugaacgggcugcagggccgcaucgacuacuacuggagcgugcugaagcccggccagacccuccggauccgcuccaacgggaaccugaucgcgccgugguacggccacauccugagcggggagagccacggccggguccucaagaccgaccugaagcgcggcuccugcaccgugcagugccagacggagaagggcgggcugaacaccacccuccccuuccagaacgugagcaaguacgccuucgggaacugcuccaaguacgucggcgucaagagccugaagcuggccguggggcuccggaacgugcccucccgcagcucccggggccuguucggcgccaucgccggguucaucgagggcggguggagcggccugguggcggggugguacggcuuccagcacuccaacgaccagggcguggggauggccgccgaccgcgacagcacccagaaggccaucgacaagaugacguccaaggucaacaacaucguggacaagaugaacaagcaguacgagaucaucaaccacgaguucagcgagaucgagacccggcucaacaugaucaacaacaagaucgacgaccagauccaggacaucugggccuacaacgcggagcugcuggugcuccuggagaaccagaagacccuggacgagcacgacgccaacgucaacaaccucuacaacaaggugaagcgcgcccugggcuccaacgccgucgaggacgggaagggcugcuucgagcuguaccacaagugcgacgaccagugcauggagaccauccggaacgggacguacaaccgccgccgguaccaggaggagagcaagcucgagcgccagaagaucgagggcgugaagcuggaguccgagggcaccuacaagauccugaccaucuacagcaccguggccuccagccucgucaucgcgaugggguucgccgccuuccuguucugggccauguccaacggcagcugccggugcaacaucugcaucuga

SEQ ID NO: 71280 - RNA, 1683 nt, Artificial Sequence
  derived and/or modified sequence opt1 from hemagglutinin__InfluenzaA__AGQ81092
auggagguggucagccugaucaccauccuccuggugaucaccggcuccaacgccgacaagaucugcaucggguaccagagcacgaacuccaccgagaccguggacacccugacggagaacaacguccccgugacccacgccaaggagcuccugcacaccgagcacaacggcaugcugugcgcgaccaaccucgggcgcccgcugauccuggacacgugcaccaucgagggccucaucuacgggaaccccagcugcgaccugcugcucggcggccgggagugguccuacaucguggagcgccccagcgccgucaacgggcugugcuaccccggcaacguggagaaccuggaggagcuccggucccuguucagcuccgccagcuccuaccagcgcauccagaucuucccggacaccaucuggaacgugagcuacaccgggacguccaaggccugcagcgacuccuucuaccggagcaugcgcuggcugacccagaagaacaacgccuaccccguccaggacgcgcaguacaccaacaaccggggccgcaacauccucuucaugugggggaucaaccacccgcccaccgacacgacccagaccaaccuguacacccggacggacaccaccaccuccguggccacggaggacaucaaccgcaccuucaagccccugaucggcccccggccccucgugaacggccugcaggggcgcaucgacuacuacugggccguccugcggcccggccagacccuccgcauccggagcaacgggaaccugaucgccccgugguacggccacauccuguccggcgagagccacgggcgcauccucaagaccgaccucaagagcggcaacugcguggugcagugccagacggagcgcgggggccugaacaccacccugcccuuccacaacgucuccaaguacgcguucgggaacugccccaaguacgugggcgucaagagccugaagcuggccgugggccuccggaacgugcccgcccgguccagccgcgggcuguucggcgccaucgccggguucaucgagggcgggugguccggccugguggcgggcugguacggguuccagcacagcaacgaccagggcaccgggauggccgccgaccgggacuccacgcagaaggccaucgacaagaucaccagcaaggucaacaacaucguggacaagaugaacaagcaguacgagaucaucgaccacgaguucuccgagaucgagacccgccucaacaugaucaacaacaagaucgacgaccagauccaggacaucugggccuacaacgcggagcugcuggugcuccuggagaaccagaagacccuggacgagcacgacgccaacgucaacaaccucuacaacaaggugaagcgcgcccugggcagcaacgccgucgaggacgggaagggcugcuucgagcuguaccacaagugcgacaaccagugcauggagacgauccggaacggcaccuacaaccgccggaaguacaaggaggagucccgccucgagcggcagaagaucgagggggugaagcuggagagcgagggcaccuacaagauccugaccaucuacuccaccguggccagcucccucgucaucgcgaugggguucgccgccuuccuguucugggccaugagcaacggcuccugccgcugcaacaucugcaucuga

SEQ ID NO: 71281 - RNA, 1683 nt, Artificial Sequence
  derived and/or modified sequence opt1 from hemagglutinin__InfluenzaA__AGQ81095
auggagguggucagccugaucaccauccuccuggugaucaccguguccaacgccgacaagaucugcaucggcuaccagagcacgaacuccaccgagaccgucaacacccugacggaggacaacgugcccgugacccacgccaaggagcuccugcacaccgagcacaacgggaugcugugcgcgaccaaccucggccgcccgcugauccuggacacgugcaccaucgaggggcucaucuacggcaaccccagcugcgaccugcugcucgggggccgggagugguccuacaucgucgagcgccccagcgccgugaacggccugugcuaccccgggaacguggagaaccuggaggagcuccggucccuguucagcuccgccagcuccuaccagcgcauccagaucuucccggacaccaucuggaacgucagcuacuccggcaccagcaaggccugcuccgacagcuucuaccgguccaugcgcuggcugacgcagaagaacaacgccuaccccgugcaggacgcgcaguacaccaacaaccgggggcgcaacauccucuucauguggggcaucaaccacccgcccaccgacaccgcccagacgaaccuguacacccggaccgacaccacgaccagcguggccaccgaggacaucaaccgcaccuucaagccccugaucgggccccggccccucgucaacggccugcagggccgcaucgacuacuacugggccgugcugaagcccgggcagacgcuccggauccgcuccaacggcaaccugaucgcgccgugguacgggcacauccugagcggcgagagccacggccggauccucaagaccgaccugaacuccgggaacugcgugguccagugccagagcgagcgcggcgggcugaacaccacccuccccuuccacaacguguccaaguacgccuucggcaacugccccaaguacgugggggucaagagccugaagcuggccgugggccuccggaacgugcccgcccgcuccagccggggccuguucggggccaucgcgggcuucaucgagggcgggugguccgggcuggucgccggcugguacggcuuccagcacagcaacgaccaggggacgggcauggccgccgaccgcgacuccacccagaaggccaucgacaagaucaccagcaaggugaacaacaucguggacaagaugaacaagcaguacgagaucaucgaccacgaguucuccgagaucgagacccggcucaacaugaucaacaacaagaucgacgaccagauccaggacaucugggcguacaacgccgagcugcugguccuccuggagaaccagaagacgcuggacgagcacgacgccaacgugaacaaccucuacaacaaggucaagcgcgcccuggggagcaacgccguggaggacggcaaggggugcuucgagcuguaccacaagugcgacaaccagugcauggagaccauccgcaacggcaccuacgaccggcgcaaguacaaggaggagucccggcucgagcgccagaagaucgagggcgugaagcuggagagcgaggggaccuacaagauccugacgaucuacuccaccgucgcgagcucccucgugaucgccaugggcuucgccgccuuccuguucugggccaugagcaacggguccugccggcgcaacaucugcaucuga

SEQ ID NO: 71282 - RNA, 1683 nt, Artificial Sequence
  derived and/or modified sequence opt1 from hemagglutinin__InfluenzaA__AGQ81099
auggagaccgugagccugaucaccauccuccugaucgucacgguguccaacgccgacaagaucugcaucggcuaccagagcaccaacuccaccgagaccguggacacgcugaccgagaacaacguccccgugacccacgccaaggagcuccugcacaccgagcacaacgggaugcugugcgcgacgaaccucggccacccgcugauccuggacacgugcaccaucgaggggcucaucuacggcaaccccagcugcgaccugcugcucgggggccgcgagugguccuacaucguggagcggcccagcgccgucaacggccugugcuaccccgggaacguggagaaccuggaggagcuccgcucccuguucagcuccgccaacagcuaccagcggauccagaucuucccggacaccaucuggaacguguccuacagcggcaccuccaaggccugcagcgacuccuucuaccgcagcaugcgguggcugacccagaagaacaacgccuaccccacccaggacgcgcaguacaccaacaaccgcgagaagaacauccucuucaugugggggaucaaccacccgcccacggacaccgcccagaccaaccuguacacccggacggacaccaccaccuccgucgccacggaggagaucaaccgcaccuucaagccccugaucggcccccggccccucgugaacgggcugcagggccgcaucgacuacuacuggagcgugcugaagcccggccagacccuccggauccgcuccaacgggaaccugaucgccccgugguacggccacauccugagcggggagagccacggccggauccucaagaccgaccugaagcgcggcuccugcacgguccagugccagaccgagaagggcgggcugaacaccacccuccccuuccagaacgugagcaaguacgcguucgggaacugcuccaaguacgugggcgucaagagccugaagcuggccguggggcuccggaacgugcccucccgcagcucccggggccuguucggcgccaucgccggguucaucgagggcggguggagcggccuggucgccgggugguacggcuuccagcacuccaacgaccagggcguggggauggcggccgaccgcgacagcacgcagaaggccaucgacaaggugaccuccaaggucaacaacaucguggacaagaugaacaagcaguacgagaucaucgaccacgaguucagcgagguggagacccggcucaacaugaucaacaacaagaucgacgaccagauccaggacaucugggccuacaacgccgagcugcugguccuccuggagaaccagaagacccuggacgagcacgacgcgaacgugaacaaccucuacaacaaggucaagcgcgcccugggcuccaacgccguggaggacgggaagggcugcuucgagcuguaccacaagugcgacgaccagugcauggagacgauccggaacgggaccuacaaccgccgcaaguaccaggaggagagcaagcucgagcggcagaagaucgagggcgugaagcuggaguccgagggcaccuacaagauccugaccaucuacagcaccgucgccuccagccucgugaucgccaugggguucgcggccuuccuguucugggccauguccaacggcagcugccgccggaacaucugcaucuga

SEQ ID NO: 71283 - RNA, 1683 nt, Artificial Sequence
  derived and/or modified sequence opt1 from hemagglutinin__InfluenzaA__AGQ81100
auggagaccgugagccugaucaccaugcuccuggucgccacggugaucaacgccgacaagaucugcaucggcuaccaguccaccaacagcaccgagaccguggacacgcugaccgagaacaacguccccgugacccacgcgaaggagcuccugcacaccgagcacaacgggaugcugugcgccacgaaccucggccacccgcugauccuggacacgugcaccaucgaggggcucaucuacggcaaccccuccugcgaccugcugcucgggggccgcgaguggagcuacaucguggagcggcccuccgccgucaacggccugugcuaccccgggaacguggagaaccuggaggagcuccgcagccuguucuccagcgccuccagcuaccagcggauccagaucuucccggacaccaucuggaacguguccuacagcggcaccuccaaggccugcagcgacuccuucuaccgcagcaugcgguggcugacccagaagaacaacgcguaccccauccaggacgcccaguacaccaacaaccgcgagaagaacauccucuucaugugggggaucaaccacccgcccaccgacacggcccagaccaaccuguacacccggaccgacacgaccaccuccgucgccaccgaggagaucaaccgcacguucaagccccugaucggcccccggccccucgugaacgggcugcagggccgcaucgacuacuacuggagcgugcugaagcccggccagacccuccggauccgcuccaacgggaaccugaucgcgccgugguacggccacauccugagcggggagagccacggccggauccucaagaccgaccugaagcgcggcuccugcaccguccagugccagacggagaagggcgggcugaacaccacccuccccuuccagaacgugagcaaguacgccuucgggaacugcuccaaguacgugggcgucaagagccugaagcuggccguggggcuccggaacgugcccucccgcagcucccggggccuguucggcgccaucgccggguucaucgagggcggguggagcggccuggucgcggggugguacggcuuccagcacuccaacgaccagggcguggggauggccgccgaccgcgacagcacccagaaggccaucgacaagaucacguccaaggugaacaacaucgucgacaagaugaacaagcaguacgagaucaucgaccacgaguucagcgagguggagacccggcucaacaugaucaacaacaagaucgacgaccagauccaggacaucugggccuacaacgcggagcugcuggugcuccuggagaaccagaagacccuggacgagcacgacgccaacgucaacaaccucuacaacaaggugaagcgcgcccugggcuccaacgccgucgaggacgggaagggcugcuucgagcuguaccacaagugcgacgaccagugcauggagaccauccggaacgggacguacaaccgccgccgguaccaggaggagagcaagcucgagcgccagaagaucgagggcgugaagcuggaguccgagggcaccuacaagauccugaccaucuacagcaccguggccuccagccucgucaucgcgaugggguucgccgccuuccuguucugggccauguccaacggcagcugccggcgcaacaucugcaucuga

SEQ ID NO: 71284 - RNA, 1683 nt, Artificial Sequence
  derived and/or modified sequence opt1 from hemagglutinin__InfluenzaA__AGQ81123
auggagguggucagccugaucaccauccuccuggugaucaccguguccaacgccgacaagaucugcaucggcuaccagagcacgaacuccaccgagaccgucaacacccugacggaggacaacgugcccgugacccacgccaaggagcuccugcacaccgagcacaacgggaugcugugcgcgaccaaccucggccgcccgcugauccuggacacgugcaccaucgaggggcucaucuacggcaaccccagcugcgaccugcugcucgggggccgggagugguccuacaucgucgagcgccccagcgccgugaacggccugugcuaccccgggaacguggagaaccuggaggagcuccggucccuguucagcuccgccagcuccuaccagcgcauccagaucuucccggacaccaucuggaacgucagcuacuccggcaccagcaaggccugcuccgacagcuucuaccgguccaugcgcuggcugacgcagaagaacaacgccuaccccgugcaggacgcgcaguacaccaacaacaaggggcggaacauccucuucauguggggcaucaaccacccgcccaccgacaccgcccagacgaaccuguacacccgcaccgacaccacgaccagcguggccaccgaggacaucaaccggaccuucaagccccugaucgggccccgcccccucgucaacggccugcagggccggaucgacuacuacugggccgugcugaagcccgggcagacgcuccgcauccgguccaacggcaaccugaucgcgccgugguacgggcacauccugcucggcgagagccacggccgcauccugaagaccgaccugaacagcggggacugcgugguccagugccaguccgagcggggcgggcucaacaccacccugcccuuccacaacgugagcaaguacgccuucggcaacugccccaaguacgugggggucaagucccugaagcucgccgugggccugcgcaacgugcccgcccggagcacgcgcggccuguucggggccaucgcgggcuucaucgagggcgggugguccgggcucgucgccggcugguacggcuuccagcacagcaacgaccaggggaccggcauggccgccgaccgggacuccacccagaaggccaucgacaagaucaccagcaaggugaacaacaucguggacaagaugaacaagcaguacgagaucaucgaccacgaguucuccgagaucgagacgcgccugaacaugaucaacaacaagaucgacgaccagauccaggacaucugggcguacaacgccgagcugcucguccugcuggagaaccagaagacccucgacgagcacgacgccaacgugaacaaccuguacaacaaggucaagcgggcccuggggagcaacgccguggaggacggcaaggggugcuucgagcucuaccacaagugcgacaaccagugcauggagaccauccgcaacggcaccuacgaccgccggaaguacaaggaggagucccgccuggagcggcagaagaucgagggcgugaagcuggagagcgaggggacguacaagauccucaccaucuacuccaccgucgcgagcucccuggugaucgccaugggcuucgccgccuuccuguucugggccaugagcaacggguccugccgcugcaacaucugcaucuga

SEQ ID NO: 71285 - RNA, 1683 nt, Artificial Sequence
  derived and/or modified sequence opt1 from hemagglutinin__InfluenzaA__AGQ81124
auggagguggccacccugaucaccauccuccuggucaucacgggcagcaacgccgacaagaucugcaucggguaccaguccaccaacagcaccgagaccguggacacgcugaccgagaacaacgugcccgucacccacgcgaaggagcuccugcacaccgagcacaacggcaugcugugcgccacgaaccucgggcgcccgcugauccuggacacgugcaccaucgagggccucaucuacgggaaccccuccugcgaccugccccuggagggccgggaguggagcuacaucguggagcgccccuccgccgugaacggcgucugcuacccggggaacguggagaaccucgaggagcugcggagccuguucuccagcgccuccagcuaccagcgcauccagaucuuccccgacuccaucuggaacgugagcuacuccggcaccagcaaggccugcuccgacagcuucuaccggaacaugcgcuggcucacccagaaggacaacaacuaccccguccaggacgcgcaguacaccaacaaccgggggaagaacauccuguucauguggggcaucaaccacccgcccaccgacaccgcccagacgaaccuguacacccgcaccgacaccacgaccuccguggccaccgaggacaucaaccggaccuucaagccccucaucgggccccgcccccuggugaacggccugcagggccggaucgacuacuacugggccguccucaagccggggcagacgcugcgcgugcggagcaacggcaaccugaucgcgcccugguacgggcacauccuccugggcgagucccacggccgcauccugaagaccgaccucaagagcgggaacugcgugguccagugccagaccgagcggggcgggcugaacaccacgcugcccuuccacaacgugagcaaguacgccuucggcaacugccccaaguacaucggggugaagucccucaagcuggccgucggccugcgcaacgugccggcccggagcucccgcggccucuucggggccaucgcgggcuucaucgagggcggguggagcgggcugguggccggcugguacggcuuccagcacuccaacgaccaggggaccggcauggccgccgaccgggacagcacccagaaggccaucgacaagaucaccuccaaggucaacaacaucguggacaagaugaacaagcaguacgagaucaucgaccacgaguucagcgagaucgagacgcgccugaacaugaucaacgacaagaucgacgaccagauccaggacaucugggcguacaacgccgagcuccuggugcugcucgagaaccagaagacccuggacgagcacgacgccaacgucaacaaccuguacaacaaggugaagcgggcccucggguccaacgccgucgaggacggcaaggggugcuucgaccuguaccacaagugcgacaaccagugcauggagaccauccgcaacggcaccuacaaccgccggaaguaccagaaggagagccgccuggagcggcagaagaucgagggcgugaagcucgaguccgaggggacguacaagauccugaccaucuacagcaccguggcguccagccuggucaucgccaugggcuucgccgccuuccucuucugggccauguccaacgggagcugccgcugcaacaucugcaucuga

SEQ ID NO: 71286 - RNA, 1683 nt, Artificial Sequence
  derived and/or modified sequence opt1 from hemagglutinin__InfluenzaA__AGQ81125
auggagguggccacccugaucaccauccuccuggucaucacgggcagcaacgccgacaagaucugcaucggguaccaguccaccaacagcaccgagaccguggacacgcugaccgagaacaacgugcccgucacccacgcgaaggagcuccugcacaccgagcacaacggcaugcugugcgccacgaaccucgggcgcccgcugauccuggacacgugcaccaucgagggccucaucuacgggaaccccuccugcgaccugccccuggagggccgggaguggagcuacaucguggagcgccccuccgccgugaacggcgucugcuacccggggaacguggagaaccucgaggagcugcggagccuguucuccagcgccuccagcuaccagcgcauccagaucuuccccgacuccaucuggaacgugagcuacuccggcaccagcaaggccugcuccgacagcuucuaccgguccaugcgcuggcucacccagaaggacaacaacuaccccguccaggacgcgcaguacaccaacaaccgggggaagaacauccuguucauguggggcaucaaccacccgcccaccgacaccgcccagacgaaccuguacacccgcaccgacaccacgaccagcguggccaccgaggacaucaaccggaccuucaagccccucaucgggccccgcccccuggugaacggccugcagggccggaucgacuacuacugggccguccucaagccggggcagacgcugcgcgugcgguccaacggcaaccugaucgcgcccugguacgggcacauccuccugggcgugagccacggccgcauccugaagaccgaccucaagagcgggaacugcgucgugcagugccagaccgagcggggcgggcugaacaccacgcugcccuuccacaacguguccaaguacgccuucggcaacugccccaaguacaucggggucaagagccucaagcuggccgugggccugcgcaacgugccggcccgguccagccgcggccucuucggggccaucgcgggcuucaucgagggcgggugguccgggcuggucgccggcugguacggcuuccagcacagcaacgaccaggggaccggcauggccgccgaccgggacuccacccagaaggccaucgacaagaucaccagcaaggugaacaacaucguggacaagaugaacaagcaguacgagaucaucgaccacgaguucuccgagaucgagacgcgccugaacaugaucaacgacaagaucgacgaccagauccaggacaucugggcguacaacgccgagcuccugguccugcucgagaaccagaagacccuggacgagcacgacgccaacgugaacaaccuguacaacaaggucaagcgggcccucgggagcaacgccguggaggacggcaaggggugcuucgaccuguaccacaagugcgacaaccagugcauggagaccauccgcaacggcaccuacaaccgccggaaguaccaggaggagucccgccuggagcggcagaagaucgagggcgugaagcucgagagcgaggggacguacaagauccugaccaucuacuccaccgucgcgagcucccuggugaucgccaugggcuucgccgccuuccucuucugggccaugagcaacggguccugccgcugcaacaucugcaucuga

SEQ ID NO: 71287 - RNA, 1683 nt, Artificial Sequence
  derived and/or modified sequence opt1 from hemagglutinin__InfluenzaA__AGQ81126
auggagaccaucagccugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccagcgccgucaacgggaccugcuaccccggcaacguggagaaccuggaggagcugcgcacccucuucuccagcgccuccagcuaccagcggauccagaucuucccggacaccaucuggaacgugacguacaccggcaccucccgcagcugcuccggcagcuucuaccgguccaugcgcuggcugacccagaaguccggguucuaccccguccaggacgccaaguacacgaacaaccggggcaagaacauccuguucgugugggggauccaccacccccacaccuacaccgaccagaccacgcucuacauccgcaacgacaccaccaccagcgugacgaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacgugcugagcggcggcagccacgggcgcauccugaagaccgaccucaagggcgggaacugcgucgugcagugccagacggagaagggcggguucaacuccacccugcccuuccacaacaucagcaaguacgccuucgggaccugcccgaaguacgugaaggucaacucccugaagcucgccaucggccugcggaacgugcccgcccgcagcaaccggggccuguucggcgcgaucgccggguucaucgagggcggguggcccggccucguggccggcugguacggguuccagcacuccaacgaccagggcgucgggauggccgccgaccgcgacagcacccagaaggcgguggacaagaucacguccaaggugaacaacaucgucgacaagaugaacaagcaguacgagaucaucgaccacgaguucagcgagguggagacccggcugaacaugaucaacaacaagaucgacgaccagauccaggacaucugggccuacaacgccgagcugcucguccugcuggagaaccagaagacccucgacgagcacgacgccaacgugaacaaccuguacaacaaggugaagcgcgcccugggcuccaacgcgauggaggacgggaagggcugcuucgagcucuaccacaagugcgacgaccagugcauggagaccauccggaacggcaccuacaaccgccgcaaguaccgggaggagagccgccuggagcagcagcggaucgagggggucaagcuggaguccgagggcacguacaagauccucaccaucuacagcaccguggccuccagccuggugcuggccaugggguucgccgccuuccucuucugggcgauguccaacggcagcugccgcugcaacaucugcaucuga

SEQ ID NO: 71288 - RNA, 1683 nt, Artificial Sequence
  derived and/or modified sequence opt1 from hemagglutinin__InfluenzaA__AGQ81127
auggagguggccacccugaucaccauccuccugcugaucacgggcagcaacgccgacaagaucugcaucggguaccaguccaccaacagcaccgagaccgucgacacgcucaccgagaacaacgugcccgugacccacgcgaaggagcugcugcacaccgagcacaacggcaugcucugcgccacgaaccuggggcgcccgcugauccucgacacgugcaccaucgagggccugaucuacgggaaccccuccugcgaccugccccucgagggccgggaguggagcuacaucgucgagcgccccuccgccgugaacggcgugugcuacccggggaacgucgagaaccuggaggagcugcggagccucuucuccagcgccuccagcuaccagcgcauccagaucuuccccgacuccaucuggaacgugagcuacuccggcaccagcaaggccugcuccgacagcuucuaccgguccaugcgcuggcugacccagaagaacaacaacuaccccgugcaggacgcgcaguacaccaacaaccgggggaagaacauccuguucauguggggcaucaaccacccgcccaccgacaccgcccagacgaaccucuacacccgcaccgacaccacgaccagcgucgccaccgaggacaucaaccggaccuucaagccccugaucgggccccgcccccuggugaacggccuccagggccggaucgacuacuacugggccgugcugaagccggggcagacgcugcgcguccgguccaacggcaaccucaucgcgcccugguacgggcacauccugcugggcgagagccacggccgcauccucaagaccgaccucaagagcgggaacugcguggugcagugccagaccgagcggggcgggcugaacaccacgcugcccuuccacaacgucuccaaguacgccuucggcaacugccccaaguacaucggggucaagagccugaagcuggccgugggccuccgcaacgugccggcccgguccagccgcggccuguucggggccaucgcgggcuucaucgagggcgggugguccgggcugguggccggcugguacggcuuccagcacagcaacgaccaggggaccggcauggccgccgaccgggacuccacccagaaggccaucgacaagaucaccagcaaggugaacaacaucgucgacaagaugaacaagcaguacgagaucaucgaccacgaguucuccgagaucgagacgcgccucaacaugaucaacgacaagaucgacgaccagauccaggacaucugggcguacaacgccgagcugcuggugcuccuggagaaccagaagacccuggacgagcacgacgccaacgugaacaaccucuacaacaaggucaagcgggcccuggggagcaacgccguggaggacggcaaggggugcuucgaccuguaccacaagugcgacaaccagugcauggagaccauccgcaacggcaccuacaaccgccggaaguaccaggaggagucccgccucgagcggcagaagaucgagggcgucaagcuggagagcgaggggacguacaagauccugaccaucuacuccaccguggcgagcucccucgugaucgccaugggcuucgccgccuuccuguucugggccaugagcaacggguccugccgcugcaacaucugcaucuga

SEQ ID NO: 71289 - RNA, 1683 nt, Artificial Sequence
  derived and/or modified sequence opt1 from hemagglutinin__InfluenzaA__AGQ81128
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggagcuacaucgucgagcgccccuccgccgugaacggcgugugcuacccggggaacgucgagaaccuggaggagcuccggagccuguucuccagcgccuccagcuaccagcgcauccagaucuuccccgacuccaucuggaacgugagcuacuccggcaccagcaaggcgugcuccgacagcuucuaccgguccaugcgcuggcugacccagaagaacaacaacuaccccgugcaggacgcccaguacaccaacaaccgggggaagaacauccucuucauguggggcaucaaccacccgcccaccgacaccgcccagacgaaccuguacacccgcaccgacaccacgaccagcgucgccaccgaggacaucaaccggaccuucaagccccugaucgggccccgcccccucgugaacggccugcagggccggaucgacuacuacugggcggugcugaagccggggcagacgcuccgcguccgguccaacggcaaccugaucgcccccugguacgggcacauccugcucggcgagagccacggccgcauccugaagaccgaccucaagagcgggaacugcguggugcagugccagaccgagcggggcgggcugaacaccacgcugcccuuccacaacgucuccaaguacgccuucggcaacugccccaaguacaucggggucaagagccugaagcucgccgugggccugcgcaacgugccggcccgguccagccgcggccuguucggggcgaucgccggcuucaucgagggcgggugguccgggcucguggccggcugguacggcuuccagcacagcaacgaccaggggaccggcauggccgccgaccgggacuccacccagaaggcgaucgacaagaucaccagcaaggugaacaacaucgucgacaagaugaacaagcaguacgacaucaucgaccacgaguucuccgagaucgagacgcgccugaacaugaucaacgacaagaucgacgaccagauccaggacaucugggccuacaacgccgagcugcucgugcugcuggagaaccagaagacccucgacgagcacgacgccaacgugaacaaccuguacaacaaggucaagcgggcccuggggagcaacgcgguggaggacggcaaggggugcuucgaccucuaccacaagugcgacaaccagugcauggagaccauccgcaacggcaccuacaaccgccggaaguaccaggaggagucccgccuggagcggcagaagaucgagggcgucaagcuggagagcgaggggacguacaagauccucaccaucuacuccaccguggccagcucccugguggucgccaugggcuucgccgccuuccuguucugggcgaugagcaacggguccugccgcugcaacaucugcaucuga

SEQ ID NO: 71290 - RNA, 1683 nt, Artificial Sequence
  derived and/or modified sequence opt1 from hemagglutinin__InfluenzaA__AGQ81130
auggagaccgugagccugaucaccauccuccuggucgugacgaucggcaacgccgacaagaucugcaucggguaccaguccaccaacagcaccgagaccguggacacgcugaccgagaacaacguccccgugacccacgccaaggagcuccugcacaccgagcacaacggcaugcugugcgcgacgucccucgggcacccgcugauccuggacacgugcaccaucgagggccucaucuacgggaaccccagcugcgaccugcugcucggcggccgcgagugguccuacaucguggagcggcccagcgccgucaacgggcugugcuaccccggcaacguggagaaccuggaggagcuccgcucccuguucagcuccgcccggagcuaccagcgcauccagaucuucccggacaccaucuggaacguguccuacagcgggaccuccaaggccugcagcgacuccuucuaccggagcaugcgcuggcugacccagaagaacaacgccuaccccauccaggacgcgcaguacaccaacaaccaggagaagaacauccucuucauguggggcaucaaccacccgcccaccgacacgguccagaccaaccuguacacccggaccgacacgaccaccuccguggccaccgaggagaucaaccgcacguucaagccccugaucgggccccggccccucgugaacggccugcagggccgcaucgacuacuacuggagcguccugaagcccgggcagacccuccggauccgcuccaacggcaaccugaucgccccgugguacgggcacauccugagcggcgagagccacggccggauccucaagaccgaccugaagcgcggguccugcaccgugcagugccagacggagaagggcgggcugaacaccacccuccccuuccagaacgugagcaaguacgccuucggcaacugcuccaaguacaucgggaugaagucccugaagcuggcggucggccuccggaacgugcccagccgcagcucccggggccuguucggggccaucgccggcuucaucgagggcggguggagcgggcugguggccggcugguacggcuuccagcacuccaacgaccagggggucggcauggccgcggaccgcgacagcacccagaaggccaucgacaagaucacguccaaggugaacaacaucguggacaagaugaacaagcaguacgagaucaucgaccacgaguucagcgaggucgagacccggcucaacaugaucaacaacaagaucgacgaccagauccaggacaucugggccuacaacgccgagcugcuggugcuccuggagaaccagaagacccuggacgagcacgacgccaacgugaacaaccucuacaacaaggucaagcgcgcgcugggguucaacgccguggaggacggcaaggggugcuucgagcuguaccacaagugcgacgaccagugcauggagaccauccggaacggcacguacaaccgccgcaaguaccaggaggaguccaagcucgagcggcagaagaucgagggcgucaagcuggagagcgaggggaccuacaagauccugaccaucuacuccaccguggccagcucccucgugaucgccaugggcuucgccgcguuccuguucugggccaugagcaacggguccugccgcugcaacaucugcaucuga

SEQ ID NO: 71291 - RNA, 1683 nt, Artificial Sequence
  derived and/or modified sequence opt1 from hemagglutinin__InfluenzaA__AGQ81132
auggagaccaucagccugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccagcgccgucaacgggaccugcuaccccggcaacguggagaaccuggaggagcugcgcacccucuucuccagcgccuccagcuaccagcggauccagaucuucccggacaccaucuggaacgugacguacaccggcaccucccgcagcugcuccggcagcuucuaccgguccaugcgcuggcugacccagaaguccggguucuaccccguccaggacgccaaguacacgaacaaccggggcaagaacauccuguucgugugggggauccaccacccccacaccuacaccgaccagaccacgcucuacauccgcaacgacaccaccaccagcgugacgaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacgugcugagcggcggcagccacgggcgcauccugaagaccgaccucaagggcgggaacugcgucgugcagugccagacggagaagggcggguucaacuccacccugcccuuccacaacaucagcaaguacgccuucgggaccugcccgaaguacgugaaggucaacucccugaagcucgccaucggccugcggaacgugcccgcccgcagcaaccggggccuguucggcgcgaucgccggguucaucgagggcggguggcccggccucguggccggcugguacggguuccagcacuccaacgaccagggcgucgggauggccgccgaccgcgacagcacccagaaggcgguggacaagaucacguccaaggugaacaacaucgucgacaagaugaaccggcaguacgagaucaucgaccacgaguucagcgagguggagacccgccugaacaugaucaacaacaagaucgacgaccagauccaggacaucugggccuacaacgccgagcugcucguccugcuggagaaccagaagacccucgacgagcacgacgccaacgugaacaaccuguacaacaaggugaagcgggcccugggcuccaacgcgauggaggacgggaagggcugcuucgagcucuaccacaagugcgacgaccagugcauggagaccauccgcaacggcaccuacaaccgccggaaguaccgcgaggagagccggcuggagcagcagcgcaucgagggggucaagcuggaguccgagggcacguacaagauccucaccaucuacagcaccguggccuccagccuggugcuggccaugggguucgccgccuuccucuucugggcgauguccaacggcagcugccggugcaacaucugcaucuga

SEQ ID NO: 71292 - RNA, 1683 nt, Artificial Sequence
  derived and/or modified sequence opt1 from hemagglutinin__InfluenzaA__AGQ81133
auggagaccaucagccugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccagcgccgucaacgggaccugcuaccccggcaacguggagaaccuggaggagcugcgcacccucuucuccagcgccuccagcuaccagcggauccagaucuucccggacaccaucuggaacgugacguacaccgggaccucccgcagcugcuccggcagcuucuaccgguccaugcgcuggcugacccagaaguccggguucuaccccguccaggacgccaaguacacgaacaaccggggcaagaacauccuguucgugugggggauccaccacccccacaccuacaccgaccagaccacgcucuacauccgcaacgacaccaccaccagcgugacgaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacauccugagcggcggcagccacgggcgcauccugaagaccgaccucaaguccggcaacugcgugguccagugccagacggagaagggcggcuucaacagcacccugcccuuccacaacaucuccaaguacgccuucgggaccugcccgaaguacgugaaggugaacagccugaagcucgccaucggccugcggaacguccccgcccgcuccaaccggggccuguucggggcgaucgccggcuucaucgagggcggguggcccgggcucguggccggcugguacggcuuccagcacagcaacgaccagggggugggcauggccgccgaccgcgacuccacccagaaggcggucgacaagaucacgagcaaggugaacaacaucguggacaagaugaacaagcaguacgagaucaucgaccacgaguucuccgaggucgagacccggcugaacaugaucaacaacaagaucgacgaccagauccaggacaucugggccuacaacgccgagcugcucgugcugcuggagaaccagaagacccucgacgagcacgacgccaacgucaacaaccuguacaacaaggugaagcgcgcccuggggagcaacgcgauggaggacggcaaggggugcuucgagcucuaccacaagugcgacgaccagugcauggagaccauccggaacggcaccuacaaccgccgcaaguaccgggaggagucccgccuggagcagcagcggaucgagggcgugaagcuggagagcgaggggacguacaagauccucaccaucuacuccaccgucgccagcucccuggugcuggccaugggcuucgccgccuuccucuucugggcgaugagcaacggguccugccgcugcaacaucugcaucuga

SEQ ID NO: 71293 - RNA, 1683 nt, Artificial Sequence
  derived and/or modified sequence opt1 from hemagglutinin__InfluenzaA__AGQ81134
auggagaccaucagccugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccagcgccgccaacgggaccugcuaccccggcaacgucgagaacccggaggagcugcgcacccuguucuccagcgccuccagcuaccagcggauccagaucuuccccgacaccaucuggaacgugacguacaccgggaccucccgcagcugcuccggcagcuucuaccgguccaugcgcuggcucacccagaaguccggguucuaccccgugcaggacgcgaaguacacgaacaaccggggcaagaacauccuguucgucugggggauccaccacccccacaccuacaccgaccagaccacgcuguacauccgcaacgacaccaccaccagcgugacgaccgaggagcucaaccggaucuucaagccggugaucgucccccgccugcuggugaacggccagcagggccggaucgacuacuacuggagcgugcucaagcccgggcagacccugcgcguccgguccaacggcaaccugaucgcccccugguacgggcacgugcucagcggcggcagccacgggcgcauccugaagaccgaccugaaguccggcaacugcgugguccagugccagacggagaagggcggcuucaacagcacccucccguuccacaacaucuccaaguacgccuucgggaccugccccaaguacgugaaggugaacagccugaagcuggccaucggccuccggaacguccccgcgcgcuccaaccggggccuguucggggccaucgccggcuucaucgagggcggguggcccgggcugguggccggcugguacggcuuccagcacagcaacgaccagggggugggcauggccgcggaccgcgacuccacccagaaggccgucgacaagaucacgagcaaggugaacaacaucguggacaagaugaacaagcaguacgagaucaucgaccacgaguucuccgaggucgagacccggcucaacaugaucaacaacaagaucgacgaccagauccaggacaucugggccuacaacgccgagcugcuggugcuccuggagaaccagaagacccuggacgagcacgacgccaacgucaacaaccucuacaacaaggugaagcgcgcgcuggggagcaacgccauggaggacggcaaggggugcuucgagcuguaccacaagugcgacgaccagugcauggagaccauccggaacggcaccuacaaccgccgcaaguaccgggaggagucccgccucgagcagcagcggaucgagggcgugaagcuggagagcgaggggacguacaagauccugaccaucuacuccaccgucgccagcucccucgugcuggccaugggcuucgccgcguuccuguucugggccaugagcaacggguccugccgcugcaacaucugcaucuga

SEQ ID NO: 71294 - RNA, 1683 nt, Artificial Sequence
  derived and/or modified sequence opt1 from hemagglutinin__InfluenzaA__AGQ81135
auggagguggccaccaucaucaccauccugcucgucaucacgggcagcaacgccgacaagaucugcaucggguaccaguccaccaacagcaccgagaccguggacacgcugaccgagaacaacgugcccgucacccacgcgaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggagcuacaucguggagcgccccuccgccgugaacggcgucugcuacccggggaacguggagaaccuggaggagcuccggagccuguucuccagcgccuccagcuaccagcgcauccagaucuuccccgacuccaucuggaacgugagcuacuccggcaccagcaaggccugcuccgacagcuucuaccgguccaugcgcuggcugacccagaagaacaacaacuaccccguccaggacgcgcaguacaccaacaaccgggggaagaacauccucuucauguggggcaucaaccacccgcccaccgacaacgcccagaccaaccuguacacgcgcaccgacaccaccacgagcguggccaccgaggacaucaaccggaccuucaagccccugaucgggccccgcccccucgugaacggccugcagggccggaucgacuacuacugggccguccugaagccggggcagacccuccgcgugcgguccaacggcaaccugaucgcgcccugguacgggcacauccugcucggcgagagccacggccgcauccugaagacggaccucaagagcgggaacugcgugguccagugccagaccgagcggggcgggcugaacaccacccugcccuuccacaacguguccaaguacagcuucggcaacugccccaaguacaucggggugaagucccugaagcucgccgucggccugcgcaacgugccggcccggagcucccgcggccuguucggggccaucgccggcuucaucgagggcggguggagcgggcucguggcgggcugguacggcuuccagcacuccaacgaccaggggacgggcauggccgccgaccgggacagcacccagaaggccaucgacaagaucaccuccaaggucaacaacaucguggacaagaugaacaagcaguacgagaucaucgaccacgaguucaacgagaucgagacccgccugaacaugaucaacaacaagaucgacgaccagauccaggacaucugggccuacaacgcggagcugcucgugcugcuggagaaccagaagacgcucgacgagcacgacgccaacgucaacaaccuguacaacaaggugaagcgggcccuggggagcaacgccgucgaggacggcaaggggugcuucgaccucuaccacaagugcgacaaccagugcauggagaccauccgcaacggcaccuacaaccgccggaaguaccaggaggagucccgccuggagcggcagaagaucgagggcgugaagcuggagagcgaggggaccuacaagauccucacgaucuacuccaccguggccagcucccuggucaucgcgaugggcuucgccgccuuccuguucugggccaugagcaacggguccugccgcugcaacaucugcaucuga

SEQ ID NO: 71295 - RNA, 1683 nt, Artificial Sequence
  derived and/or modified sequence opt1 from hemagglutinin__InfluenzaA__AGQ81136
auggagaccaucagccugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccagcgccgucaacgggaccugcuaccccggcaacguggagaaccuggaggagcugcgcacccucuucuccagcgccuccagcuaccagcggauccagaucuucccggacaccaucuggaacgugacguacaccggcaccucccgcagcugcuccggcagcuucuaccgguccaugcgcuggcugacccagaaguccggguucuaccccguccaggacgccaaguacacgaacaaccggggcaagaacauccuguucgugugggggauccaccacccccacaccuacaccgaccagaccacgcucuacauccgcaacgacaccaccaccagcgugacgaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacgugcugagcggcggcagccacgggcgcauccugaagaccgaccucaagggcgggaacugcgucgugcagugccagacggagaagggcggguucaacuccacccugcccuuccacaacaucagcaaguacgccuucgggaccugcccgaaguacgugaaggucaacucccugaagcucgccaucggccugcggaacgugcccgcccgcagcaaccggggccuguucggcgcgaucgccggguucaucgagggcggguggcccggccucguggccggcugguacggguuccagcacuccaacgaccagggcgucgggauggccgccgaccgcgacagcacccagaaggcgguggacaagaucacguccaaggugaacaacaucgucgacaagaugaaccggcaguacgagaucaucgaccacgaguucagcgagguggagacccgccugaacaugaucaacaacaagaucgacgaccagauccaggacaucuggaccuacaacgccgagcugcucguccugcuggagaaccagaagacccucgacgagcacgacgccaacgugaacaaccuguacaacaaggugaagcgggcccugggcuccaacgccauggaggacgggaagggcugcuucgagcucuaccacaagugcgacgaccagugcauggagaccauccgcaacggcacguacaaccgccggaaguaccgcgaggagagccggcuggagcagcagcgcaucgagggggucaagcuggaguccgagggcaccuacaagauccucaccaucuacagcaccguggcguccagccuggugcuggccaugggguucgccgccuuccucuucugggccauguccaacggcagcugccggugcaacaucugcaucuga

SEQ ID NO: 71296 - RNA, 1683 nt, Artificial Sequence; identical to SEQ ID NO: 71291
  derived and/or modified sequence opt1 from hemagglutinin__InfluenzaA__AGQ81137

SEQ ID NO: 71297 - RNA, 1683 nt, Artificial Sequence
  derived and/or modified sequence opt1 from hemagglutinin__InfluenzaA__AGQ81138
auggaggccgccaccaucaucaccauccugcucgcgaucacgggcagcaacgccgacaagaucugcaucggguaccaguccaccaacagcaccgagaccguggacacgcugaccgagaacaacguccccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggagcuacaucguggagcgccccuccgccgucaacggcgugugcuacccggggcacguggagaaccuggaggagcuccggagccuguucuccagcgcguccagcuaccagcgcguccagaucuuccccgacuccaucuggaacgugagcuacuccggcaccagcaaggccugcuccgacagcuucuaccgguccaugcgcuggcugacccagaagaacaacaacuaccccgugcaggacgcccaguacaccaacaacaaggggaagaacauccucuucauguggggcaucaaccacccgcccaccgacaccgcccagacgaaccuguacacccggaccgacaccacgaccagcgucgcgaccgaggacaucaaccgcaccuucaagccccugaucgggccccggccccucgugaacggccugcagggccgcaucgacuacuacugggccgugcugaagccggggcagacgcuccggguccgcuccaacggcaaccugaucgcccccugguacgggcacauccugcucggcgagagccacggccggauccugaagaccgaccucaagagcgggaacugcguggugcagugccagaccgagcgcggcgggcugaacaccacgcugcccuuccacaacgucuccaaguacgccuucggcaacugccccaaguacaucggggucaagagccugaagcucgccgugggccugcggaacgugcacgcgcgcuccagccggggccuguucggggccaucgccggcuucaucgagggcgggugguccgggcucguggccggcugguacggcuuccagcacagcaacgaccaggggaccggcauggccgcggaccgcgacuccacccagaaggccaucgacaagaucaccagcaaggugaacaacaucgucgacaagaugaacaagcaguacgagaucaucgaccacgaguucuccgagaucgagacgcggcugaacaugaucaacgacaagaucgacgaccagauccaggacaucugggccuacaacgccgagcugcucgugcugcuggagaaccagaagacccucgacgagcacgacgccaacgugaacaaccuguacaacaaggucaagcgcgcgcuggggagcaacgccguggaggacggcaaggggugcuucgaccucuaccacaagugcgacaaccagugcauggagaccauccggaacggcaccuacaaccgccgcaaguaccaggaggagucccggcuggagcgccagaagaucgagggcgucaagcuggagagcgaggggacguacaagauccucaccaucuacuccaccguggccagcucccuggugaucgccaugggcuucgccgcguuccuguucugggccaugagcaacggguccugccggugcaacaucugcaucuga

SEQ ID NO: 71298 - RNA, 1683 nt, Artificial Sequence
  derived and/or modified sequence opt1 from hemagglutinin__InfluenzaA__AGQ81139
auggagguggccaccaucaucaccauccugcucgucaucacgggcgggaacgccgacaagaucugcaucggcuaccagagcaccaacuccaccgagaccguggacacgcugaccgagaacaacgugcccgucacccacgcgaaggagcugcuccacaccgagcacaacgggaugcugugcgccacgaaccugggccgcccgcucauccuggacacgugcaccaucgaggggcugaucuacggcaaccccagcugcgaccucccccuggagggccgggagugguccuacaucguggagcgcagcuccgccgugaacggggucugcuaccccggcaacguggagaaccuggaggagcuccggagccuguucuccagcgccuccagcuaccagcgcauccagaucuucccggacuccaucuggaacgugagcuacuccgggaccagcaaggccugcuccgacagcuucuaccgguccaugcgcuggcugacccagaagaacaacaacuaccccguccaggacgcgcaguacaccaacaaccggggcaagaacauccucuucaugugggggaucaaccacccgcccaccgacaacgcccagaccaaccuguacacgcgcaccgacaccaccacgagcguggccaccgaggacaucaaccggaccuucaagccccugaucggcccccgcccccucgugaacggccugcaggggcggaucgacuacuacugggccguccugaagcccggccagacccuccgcgugcgguccaacgggaaccugaucgcgccgugguacggccacauccugcucggcgagagccacgggcgcauccugaagacggaccucaagagcggcaacugcgugguccagugccagaccgagcgcgggggccugaacaccacccugcccuuccacaacguguccaaguacagcuucgggaacugccccaaguacaucggcgugaagucccugaagcucgccgucggccugcggaacgugcccgcccggagcucccgcgggcuguucggcgccaucgccggguucaucgagggcggguggagcggccucguggcgggcugguacggguuccagcacuccaacgaccagggcacggggauggccgccgaccgggacagcacccagaaggccaucgacaagaucaccuccaaggucaacaacaucguggacaagaugaacaagcaguacgagaucaucgaccacgaguucagcgagaucgagacccgccugaacaugaucaacaacaagaucgacgaccagauccaggacaucugggccuacaacgcggagcugcucgugcugcuggagaaccagaagacgcucgacgagcacgacgccaacgucaacaaccuguacaacaaggugaagcgggcccugggcuccaacgccgucgaggacgggaagggcugcuucgaccucuaccacaagugcgacaaccagugcauggagaccauccgcaacggcaccuacaaccgccggaaguaccaggaggagagccgccuggagcggcagaagaucgagggggugaagcuggaguccgagggcaccuacaagauccucacgaucuacagcaccguggccuccagccuggucaucgcgaugggguucgccgccuuccuguucugggccauguccaacggcagcugccgcugcaacaucugcaucuga

SEQ ID NO: 71299 - RNA, 1683 nt, Artificial Sequence
  derived and/or modified sequence opt1 from hemagglutinin__InfluenzaA__AGQ81141
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacggaccuggggcgcccgcucauccuggacacgugcaccaucgagggccugaucuacgggaaccccuccugcgaccucccccuggagggccgggaguggagcuacaucgucgagcgccccuccgccgugaacggcgugugcuacccggggaacgucgagaaccuggaggagcuccggagccuguucuccagcgccuccagcuaccagcgcauccagaucuuccccgacuccaucuggaacgugagcuacuccggcaccagcaaggcgugcuccgacagcuucuaccgguccaugcgcuggcugacccagaagaacaacaacuaccccgugcaggacgcccaguacaccaacaaccgggggaagaacauccucuucauguggggcaucaaccacccgcccaccgacaccgcccagacgaaccuguacacccgcaccgacaccacgaccagcgucgccaccgaggacaucaaccggaccuucaagccccugaucgggccccgcccccucgugaacggccugcagggccggaucgacuacuacugggcggugcugaagccggggcagacgcuccgcguccgguccaacggcaaccugaucgcccccugguacgggcacauccugcucggcgagagccacggccgcauccugaagaccgaccucaagagcgggaacugcguggugcagugccagaccgagcggggcgggcugaacaccacgcugcccuuccacaacgucuccaaguacgccuucggcaacugccccaaguacaucggggucaagagccugaagcucgccgugggccugcgcaacgugccggcccggucccgccggggccuguucggggcgaucgccggcuucaucgagggcggguggaccgggcucguggccggcugguacggcuuccagcacagcaacgaccaggggaccggcauggccgccgaccgcgacuccacccagaaggcgaucgacaagaucacgagcaaggugaacaacaucgucgacaagaugaacaagcaguacgacaucaucgaccacgaguucuccgagaucgagacccggcugaacaugaucaacgacaagaucgacgaccagauccaggacaucugggccuacaacgccgagcugcucgugcugcuggagaaccagaagacccucgacgagcacgacgccaacgugaacaaccuguacaacaaggucaagggggcccugggcagcaacgcgguggaggacgggaagggcugcuucgaccucuaccacaagugcgacaaccagugcauggagaccauccgcaacggcacguacaaccgccggaaguaccaggaggagucccgccuggagcggcagaagaucgagggggucaagcuggagagcgagggcaccuacaagauccucaccaucuacuccaccguggccagcucccuggugaucgccaugggguucgccgccuuccuguucugggcgaugagcaacggcuccugccgcugcaacaucugcaucuga

SEQ ID NO: 71300 - RNA, 1683 nt, Artificial Sequence
  derived and/or modified sequence opt1 from hemagglutinin__InfluenzaA__AGQ81143
auggagguggccaccaucaucaccauccugcucgucaucacgggcagcaacgccgacaagaucugcaucggguaccaguccaccaacagcaccgagaccguggacacgcugaccgagaacaacgugcccgucacccacgcgaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggagcuacaucguggagcgccccuccgccgugaacggcgucugcuacccggggaacguggagaaccuggaggagcuccggagccuguucuccagcgccuccagcuaccagcgcauccagaucuuccccgacuccaucuggaacgugagcuacuccggcaccagcaaggccugcuccgacagcuucuaccgguccaugcgcuggcugacccagaagaacaacaacuaccccguccaggacgcgcaguacaccaacaaccgggggaagaacauccucuucauguggggcaucaaccacccgcccaccgacaacgcccagaccaaccuguacacgcgcaccgacaccaccacgagcguggccaccgaggacaucaaccggaccuucaagccccugaucgggccccgcccccucgugaacggccugcagggccggaucgacuacuacugggccguccugaagccggggcagacccuccgcgugcgguccaacggcaaccugaucgcgcccugguacgggcacauccugcucggcgagagccacggccgcauccugaagacggaccucaagagcgggaacugcgugguccagugccagaccgagcggggcgggcugaacaccacccugcccuuccacaacguguccaaguacagcuucggcaacugccccaaguacaucggggugaagucccugaagcucgccgucggccugcgcaacgugccggcccggagcucccgcggccuguucggggccaucgccggcuucaucgagggcggguggagcgggcucguggcgggcugguacggcuuccagcacuccaacgaccaggggacgggcauggccgccgaccgggacagcacccagaaggccaucgacaagaucaccuccaaggucaacaacaucguggacaagaugaacaagcaguacgagaucaucgaccacgaguucagcgagaucgagacccgccugaacaugaucaacaacaagaucgacgaccagauccaggacaucugggccuacaacgcggagcugcucgugcugcuggagaaccagaagacgcucgacgagcacgacgccaacgucaacaaccuguacaacaaggugaagcgggcccugggguccaacgccgucgaggacggcaaggggugcuucgaccucuaccacaagugcgacaaccagugcauggagaccauccgcaacggcaccuacaaccgccggaaguaccaggaggagagccgccuggagcggcagaagaucgagggcgugaagcuggaguccgaggggaccuacaagauccucacgaucuacagcaccguggccuccagccuggucaucgcgaugggcuucgccgccuuccuguucugggccauguccaacgggagcugccgcugcaacaucugcaucuga

SEQ ID NO: 71301 - RNA, 1683 nt, Artificial Sequence
  derived and/or modified sequence opt1 from hemagglutinin__InfluenzaA__AGQ81144
auggaggccgccaccaucaucaccauccugcucguggucacgggcagcaacgcggacaagaucugcaucggguaccaguccaccaacagcaccgagaccguggacacgcugaccgagaacaacgugcccgucacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggagcuacaucguggagcgccccuccgccgugaacggcgucugcuacccggggaacguggagaaccuggaggagcuccggagccuguucuccagcgccuccagcuaccagcgcauccagaucuuccccgacuccaucuggaacgugagcuacggcgggaccuccaaggcgugcagcgacuccuucuaccggagcaugcgcuggcugacccagaagaacaacaacuaccccguccaggacgcccaguacaccaacaaccggggcaagaacauccucuucaugugggggaucaaccacccgcccaccgacaccgcccagacgaaccuguacacccgcaccgacaccacgaccuccguggccaccgaggacaucaaccggaccuucaagccccugaucggcccccgcccccucgugaacggccugcaggggcggaucgacuacuacugggcgguccugaagccgggccagacgcuccgcgugcggagcaacgggaaccugaucgcccccugguacggccacauccugcucggcgagucccacgggcgcauccugaagaccgaccucaagagcggcaacugcgugguccagugccagaccgagcgcgggggccugaacaccacgcugcccuuccacaacgugagcaaguacgccuucgggaacugccccaaguacaucggcgugaagucccugaagcucgccgucggccugcggaacaugccggcccggagcucccgcgggcuguucggcgcgaucgccggguucaucgagggcggguggagcggccucguggccggcugguacggguuccagcacuccaacgaccagggcaccgggauggccgccgaccgggacagcacccagaaggcgaucgacaagaucaccuccaaggugaacaacaucgucgacaagaugaacaagcaguacgagaucaucgaccacgaguucagcgagaucgagacgcgccugaacaugaucaacgacaagaucgacgaccagauccaggacaucugggccuacaacgccgagcugcucgugcugcuggagaaccagaagacccucgacgagcacgacgccaacgugaacaaccuguacaacaaggucaagcgggcccugggcuccaacgcgguggaggacgggaagggcugcuucgaccucuaccacaagugcgacaaccagugcauggagaccauccgcaacggcaccuacaaccgccggaaguaccaggaggagagccgccuggagcggcagaagaucgagggggucaagcuggaguccgagggcacguacaagauccucaccaucuacagcaccguggccuccagccuggugaucgccaugggguucgccgccuuccuguucugggcgauguccaacggcagcugccgcugcaacaucugcaucuga

SEQ ID NO: 71302 - RNA, 1683 nt, Artificial Sequence
  derived and/or modified sequence opt1 from hemagglutinin__InfluenzaA__AGQ81146
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggcaaggaguggagcuacaucgucgagcggcccuccgccgugaacggcaugugcuacccggggaacguggagaaccuggaggagcuccgcagccuguucuccagcgccuccagcuaccagcggauccagaucuuccccgacuccaucuggaacgucagcuacuccggcaccagcaaggcgugcuccgacagcuucuaccgcuccaugcgguggcugacccagaagaacaacaacuaccccgugcaggacgcccaguacaccaacaaccgcgggaagaacauccucuucauguggggcaucaaccacccgcccaccgacaccgcccagacgaaccuguacacccggaccgacaccaagacgagcguggccaccgaggagaucaaccgcaccuucaagccccugaucgggccccggccccucgucaacggccugcagggccgcaucgacuacuacugggcggugcugaagccggggcagacccuccgggugcgcuccaacggcaaccugaucgcccccugguacgggcacauccugcucggcgagagccacggccggauccugaagacggaccucaagagcgggaacugcgucgugcagugccagaccgagcgcggcgggcugaacaccacccugcccuuccacaacguguccaaguacgccuucggcaacugccccaaguacaucggggucaagagccugaagcucgccgugggccugcggaacgugccggcccgcuccagccggggccuguucggggcgaucgccggcuucaucgagggcgggugguccgggcucgucgccggcugguacggcuuccagcacagcaacgaccaggggacgggcauggccgccgaccgcgacuccacccagaaggcgaucgacaagaucaccagcaaggugaacaacaucguggacaagaugaacaagcaguacgagaucaucgaccacgaguucuccgagaucgagacccggcugaacaugaucaacgacaagaucgacgaccagauccaggacaucugggccuacaacgccgagcugcucguccugcuggagaaccagaagacgcucgacgagcacgacagcaacgugaacaaccuguacaacaaggugaagcgcgcccugggguccaacgccgucgaggacggcaaggggugcuucgaccucuaccacaagugcgacaaccagugcauggagaccauccggaacggcaccuacaaccgccgcaaguaccaggaggagagccggcuggagcgccagaagaucgagggcgugaagcuggaguccgaggggaccuacaagauccucacgaucuacagcaccgucgcguccagccuggugaucgccaugggcuucgccgccuuccuguucugggccauguccaacgggagcugccggugcaacaucugcaucuga

SEQ ID NO: 71303 - RNA, 1683 nt, Artificial Sequence
  derived and/or modified sequence opt1 from hemagglutinin__InfluenzaA__AGQ81147
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggcaaggaguggagcuacaucgucgagcggcccuccgccgugaacggcaugugcuacccggggaacguggagaaccuggaggagcuccgcagccuguucuccagcgccuccagcuaccagcggauccagaucuuccccgacuccaucuggaacgucagcuacuccggcaccagcaaggcgugcuccgacagcuucuaccgcuccaugcgguggcugacccagaagaacaacaacuaccccgugcaggacgcccaguacaccaacaaccgcgggaagaacauccucuucauguggggcaucaaccacccgcccaccgacaccgugcagacgaaccuguacacccggaccgacaccaagacgagcgucgccaccgaggagaucaaccgcaccuucaagccccugaucgggccccggccccucgugaacggccugcagggccgcaucgacuacuacugggccgugcugaagccggggcagacccuccggguccgcuccaacggcaaccugaucgcgcccugguacgggcacauccugcucggcgagagccacggccggauccugaagacggaccucaagagcgggaacugcguggugcagugccagaccgagcgcggcgggcugaacaccacccugcccuuccacaacgucuccaaguacgccuucggcaacugccccaaguacaucggggucaagagccugaagcucgccgugggccugcggaacgugccggcccgcuccagccggggccuguucggggccaucgcgggcuucaucgagggcgggugguccgggcucguggccggcugguacggcuuccagcacagcaacgaccaggggacgggcauggccgccgaccgcgacuccacccagaaggccaucgacaagaucaccagcaaggugaacaacaucgucgacaagaugaacaagcaguacgagaucaucgaccacgaguucuccgagaucgagacccggcugaacaugaucaacgacaagaucgacgaccagauccaggacaucugggcguacaacgccgagcugcucgugcugcuggagaaccagaagacgcucgacgagcacgacgccaacgugaacaaccuguacaacaaggucaagcgcgcccuggggagcaacgccguggaggacggcaaggggugcuucgaccucuaccacaagugcgacaaccagugcauggagaccauccggaacggcaccuacaaccgccgcaaguaccaggaggagucccggcuggagcgccagaagaucgagggcgucaagcuggagagcgaggggaccuacaagauccucacgaucuacuccaccguggcgagcucccuggugaucgccaugggcuucgccgccuuccuguucugggccaugagcaacggguccugccggugcaacaucugcaucuga

SEQ ID NO: 71304 - RNA, 1683 nt, Artificial Sequence
  derived and/or modified sequence opt1 from hemagglutinin__InfluenzaA__AGQ81148
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggcaaggaguggagcuacaucgucgagcggcccuccgccgugaacggcaugugcuacccggggaacguggagaaccuggaggagcuccgcagccuguucuccagcgccuccagcuaccagcggauccagaucuuccccgacuccaucuggaacgucagcuacuccggcaccagcaaggcgugcuccgacagcuucuaccgcuccaugcgguggcugacccagaagaacaacaacuaccccgugcaggacgcccaguacaccaacaaccgcgggaagaacauccucuucauguggggcaucaaccacccgcccaccgacaccgcccagacgaaccuguacacccggaccgacaccaagacgagcguggccaccgaggagaucaaccgcaccuucaagccccugaucgggccccggccccucgucaacggccugcagggccgcaucgacuacuacugggcggugcugaagccggggcagacccuccgggugcgcuccaacggcaaccugaucgcccccugguacgggcacauccugcucggcgagagccacggccggauccugaagacggaccucaagagcgggaacugcgucgugcagugccagaccgagcgcggcgggcugaacaccacccugcccuuccacaacguguccaaguacgccuucggcaacugccccaaguacaucggggucaagagccugaagcucgccgugggccugcggaacgugccggcccgcuccagccggggccuguucggggcgaucgccggcuucaucgagggcgggugguccgggcucgucgccggcugguacggcuuccagcacagcaacgaccaggggacgggcauggccgccgaccgcgacuccacccagaaggcgaucgacaagaucaccagcaaggugaacaacaucguggacaagaugaacaagcaguacgagaucaucgaccacgaguucuccgagaucgagacccggcugaacaugaucaacgacaagaucgacgaccagauccaggacaucugggccuacaacgccgagcugcucguccugcuggagaaccagaagacgcucgacgagcacgacgccaacgugaacaaccuguacaacaaggugaagcgcgcccuggggagcaacgcggucgaggacggcaaggggugcuucgaccucuaccacaagugcgacaaccagugcauggagaccauccggaacggcaccuacaaccgccgcaaguaccaggaggagucccggcuggagcgccagaagaucgagggcgugaagcuggagagcgaggggaccuacaagauccucacgaucuacuccaccgucgccagcucccuggugaucgccaugggcuucgccgccuuccuguucugggcgaugagcaacggguccugccggugcaacaucugcaucuga

SEQ ID NO: 71305 - RNA, 1683 nt, Artificial Sequence
  derived and/or modified sequence opt1 from hemagglutinin__InfluenzaA__AGQ81149
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccggccacaacgggaugcugugcgccacgaaccugggccgcccgcucauccuggacacgugcaccaucgaggggcugaucuacggcaaccccuccugcgaccucccccuggagggccgggaguggagcuacaucgucgagcgccccuccgccaucaacggggugugcuacccgggcaacguggagaaccuggaggagcuccggagccuguucuccagcgccuccagcuaccagcgcauccagaucuuccccgacuccaucuggaacgucagcuacuccgggaccagcaaggcgugcuccgacagcuucuaccgguccaugcgcuggcugacccagaagaacaacaacuaccccgugcaggacgcccaguacaccaacaaccggggcaagaacauccucuucaugugggggaucaaccacccgcccaccgacaccgcccagacgaaccuguacacccgcaccgacaccacgaccagcguggccaccgaggacaucaaccggaccuucaagccccugaucggcccccgcccccucgucaacggccugcaggggcggaucgacuacuacugggcggugcugaagccgggccagacgcuccgcgugcgguccaacgggaaccugaucgcccccugguacggccacauccugcucggcgagagccacgggcgcauccugaagaccgaccucaagagcggcaacugcgucgugcagugccagaccgagcgcgggggccugaacaccacgcugcccuuccacaacguguccaaguacgccuucgggaacugccccaaguacaucggcgucaagagccugaagcucgccgugggccugcggaacgugccggcccgguccagccgcgggcuguucggcgcgaucgccggguucaucgagggcgggugguccggccucgucgccggcugguacggguuccagcacagcaacgaccagggcaccgggauggccgccgaccgggacuccacccagaaggcgaucgacaagaucaccagcaaggugaacaacaucguggacaagaugaacaagcaguacgagaucaucgaccacgaguucuccgagaucgagacgcgccugaacaugaucaacgacaagaucgacgaccagauccaggacaucugggccuacaacgccgagcugcucguccugcuggagaaccagaagacccucgacgagcacgacgccaacgugaacaaccuguacaacaaggugaagcgggcccugggcagcaacgcggucgaggacgggaagggcugcuucgaccucuaccacaagugcgacaaccagugcauggagaccauccgcaacggcaccuacaaccgccggaaguaccaggaggagucccgccuggagcggcagaagaucgagggggugaagcuggagagcgagggcacguacaagauccucaccaucuacuccaccgucgccagcucccuggugaucgccaugggguucgccgccuuccuguucugggcgaugagcaacggcuccugccgcugcaacaucugcaucuga

SEQ ID NO: 71306 - RNA, 1683 nt, Artificial Sequence
  derived and/or modified sequence opt1 from hemagglutinin__InfluenzaA__AGQ81150
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacggaccuggggcgcccgcucauccuggacacgugcaccaucgagggccugaucuacgggaaccccuccugcgaccucccccuggagggccgggaguggagcuacaucgucgagcgccccuccgccgugaacggcgugugcuacccggggaacgucgagaaccuggaggagcuccggagccuguucuccagcgccuccagcuaccagcgcauccagaucuuccccgacuccaucuggaacgugagcuacuccggcaccagcaaggcgugcuccgacagcuucuaccgguccaugcgcuggcugacccagaagaacaacaacuaccccgugcaggacgcccaguacaccaacgaccgggggaacaacauccucuucauguggggcaucaaccacccgcccaccgacaccguccagacgaaccuguacacccgcaccgacaccacgaccagcguggccaccgaggacaucaaccggaccuucaagccccugaucgggccccgcccccucgugaacggccugcagggccggaucgacuacuacugggccguccugaagccggggcagacgcuccgcgugcgguccaacggcaaccugaucgcgcccugguacgggcacauccugcucggcgagagccacggccgcauccugaagaccgaccucaagagcgggaacugcgugguccagugccagaccgagcggggcgggcugaacaccacgcugcccuuccacaacguguccaaguacgccuucggcaacugccccaaguacaucggggucaagagccugaagcucgccgugggccugcgcaacgugccggcccgguccagccgcggccuguucggggccaucgcgggcuucaucgagggcgggugguccgggcucguggccggcugguacggcuuccagcacagcaacgaccaggggaccggcauggccgccgaccgggacuccacccagaaggccaucgacaagaucaccagcaaggucaacaacaucguggacaagaugaacaagcaguacgacaucaucgaccacgaguucuccgagaucgagacgcgccugaacaugaucaacgacaagaucgacgaccagauccaggacaucugggcguacaacgccgagcugcucgugcugcuggagaaccagaagacccucgacgagcacgacgccaacgucaacaaccuguacaacaaggugaagcgggcccuggggagcaacgccgucgaggacggcaaggggugcuucgaccucuaccacaagugcgacaaccagugcauggagaccauccgcaacggcaccuacaaccgccggaaguaccaggaggagucccgccuggagcggcagaagaucgagggcgugaagcuggagagcgaggggacguacaagauccucaccaucuacuccaccguggcgagcucccuggucaucgccaugggcuucgccgccuuccuguucugggccaugagcaacggguccugccgcugcaacaucugcaucuga

SEQ ID NO: 71307 - RNA, 1683 nt, Artificial Sequence
  derived and/or modified sequence opt1 from hemagglutinin__InfluenzaA__AGQ81152
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggagcuacaucgucgagcgccccuccgccgugaacggcgugugcuacccggggaacgucgagaaccuggaggagcuccggagccuguucuccagcgccuccagcuaccagaagauccagaucuuccccgacuccaucuggaacgugagcuacuccggcaccagcaaggcgugcuccgacagcuucuaccgcuccaugcgguggcugacccagaagaacaacaacuaccccgugcaggacgcccaguacaccaacaaccgcgggaagaacauccucuucauguggggcaucaaccacccgcccaccgacaccguccagacgaaccuguacacccggaccgacaccacgaccagcguggccaccgaggacaucaaccgcaccuucaagccccugaucgggccccggccccucgugaacggccugcagggccgcaucgacuacuacugggccguccugaagccggggcagacgcuccgggugcgcuccaacggcaaccugaucgcgcccugguacgggcacauccugcucggcgagagccacggccggauccugaagaccgaccucaagagcgggaacugcgugguccagugccagaccgagcgcggcgggcugaacaccacgcugcccuuccacaacguguccaaguacgccuucggcaacugccccaaguacaucggggucaagagccugaagcucgccgugggccugcggaacgugccggcccgcuccagccggggccuguucggggccaucgcgggcuucaucgagggcgggugguccgggcucguggccggcugguacggcuuccagcacagcaacgaccaggggaccggcauggccgccgaccgcgacuccacccagaaggccaucgacaagaucaccagcaaggucaacaacaucguggacaagaugaacaagcaguacgagaucaucgaccacgaguucuccgagaucgagacgcggcugaacaugaucaacgacaagaucgacgaccagauccaggacaucugggcguacaacgccgagcugcucgugcugcuggagaaccagaagacccucgacgagcacgacgccaacgucaacaaccuguacaacaaggugaagcgcgcccuggggagcaacgccgucgaggacggcaaggggugcuucgaccucuaccacaagugcgacaaccagugcauggagaccauccggaacggcaccuacaaccgccgcaaguaccaggaggagucccggcuggagcgccagaagaucgagggcgugaagcuggagagcgaggggacguacaagauccucaccaucuacuccaccguggcgagcucccuggucaucgccaugggcuucgccgccuuccuguucugggccaugagcaacggguccugccggugcaacaucugcaucuga

SEQ ID NO: 71308 - RNA, 1683 nt, Artificial Sequence
  derived and/or modified sequence opt1 from hemagglutinin__InfluenzaA__AGQ81153
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggagcuacaucgucgagcgccccuccgccgugaacggcgugugcuacccggggaacgucgagaaccuggaggagcuccggagccuguucuccagcgccuccagcuaccagaagauccagaucuuccccgacuccaucuggaacgugagcuacggcgggaucuccaaggcgugcagcaacuccuucuaccgcagcaugcgguggcugacccagaagaacaacaacuaccccgugcaggacgcccaguacaccaacaaccgcggcaagaacauccucuucaugugggggaucaaccacccgcccaccaacaccacccagacggaccuguacacccggaccgacaccacgaccuccgucgccaccgaggacauccaccgcaccuucaagccccugaucggcccccggccccucgugaacggccugcaggggcgcaucgacuacuacugggccgugcugaagccgggccagacgcuccggguccgcagcaacgggaaccugaucgcgcccugguacggccacauccugcucggcaagucccacgggcggauccugaagaccgaccucaagagcggcaacugcguggugcagugccagaccgagcgcgggggccugaacaccacgcugcccuuccacaacgucagcaaguacgccuucgggaacugccccaaguacaucggcgugaagucccugaagcucgccgugggccugcggaacgucccggcccgcagcucccgggggcuguucggcgccaucgcgggguucaucgagggcggguggagcggccucguggccggcugguacggguuccagcacuccaacgaccagggcaccgggauggccgccgaccgcgacagcacccagaaggccaucgacaagaucaccuccaaggugaacaacaucgucgacaagaugaacaagcaguacgagaucaucgaccacgaguucagcgagaucgagacgcggcugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgcgcccugggcuccaacgccguggaggacgggaagggcugcuucgaccucuaccacaagugcgacaaccagugcauggagaccauccggaacggcaccuacaaccgccgcaaguaccaggaggagagccggcuggagcgccagaagaucgagggggucaagcuggaguccgagggcacguacaagauccucaccaucuacagcaccguggcguccagccuggugaucgccaugggguucgccgccuuccuguucugggccauguccaacggcagcugccggugcaacaucugcaucuga

SEQ ID NO: 71309 - RNA, 1683 nt, Artificial Sequence
  derived and/or modified sequence opt1 from hemagglutinin__InfluenzaA__AGQ81155
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggagcuacaucgucgagcgccccuccgccgugaacggcgugugcuacccggggaacgucgagaaccuggaggagcuccggagccuguucuccagcgccuccagcuaccagaagauccagaucuuccccgacuccaucuggaacgugagcuacaacggcaccuccaaggcgugcagcgacuccuucuaccgcagcaugcgguggcugacccagaagaacaacaacuaccccgugcaggacgcccaguacaccaacaaccgcgggaagaacauccucuucauguggggcaucaaccacccgcccaccgacaccacgcagaccaaccuguacacccggaccgacacgaccaccuccgucgccaccgaggacaucaaccgcacguucaagccccugaucgggccccggccccucgugaacggccugcagggccgcaucgacuacuacugggccgugcugaagccggggcagacccuccggguccgcagcaacggcaaccugaucgcgcccugguacgggcacauccugcucggcgagucccacggccggauccugaagaccgaccucaagagcgggaacugcguggugcagugccagaccgagcgcggcgggcugaacacgacccugcccuuccacaacgucagcaaguacgccuucggcgacugccccaaguacaucggggugaagucccugaagcucgccgugggccugcggaacgucccggcccgcagcucccggggccuguucggggccaucgcgggcuucaucgagggcggguggagcgggcucguggccggcugguacggcuuccagcacuccaacgaccaggggaccggcauggccgccgaccgcgacagcacccagaaggccaucgacaagaucacguccaaggugaacaacaucgucgacaagaugaacaagcaguacgagaucaucgaccacgaguucagcgagaucgagacccggcugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgcgcccugggguccaacgccguggaggacggcaaggggugcuucgaccucuaccacaagugcgacaaccagugcauggagaccauccggaacggcacguacaaccgccgcaaguaccaggaggagagccggcuggagcgccaggagaucgagggcgucaagcuggaguccgaggggaccuacaagauccucaccaucuacagcaccguggcguccagccuggugaucgccaugggcuucgccgccuuccuguucugggccauguccaacgggagcugccggugcaacaucugcaucuga

SEQ ID NO: 71310 - RNA, 1683 nt, Artificial Sequence
  derived and/or modified sequence opt1 from hemagglutinin__InfluenzaA__AGQ81156
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggagcuacaucgucgagcgccccuccgccgugaacggcgugugcuacccggggaacgucgagaaccuggaggagcuccggagccuguucuccagcgccuccagcuaccagaagauccagaucuuccccgacuccaucuggaacgugagcuacggcgggaucuccaaggcgugcagcaacuccuucuaccgcagcaugcgguggcugacccagaagaacaacaacuaccccgugcaggacgcccaguacaccaacaaccgcggcaagaacauccucuucaugugggggaucaaccacccgcccaccaacaccacccagacggaccuguacacccggaccgacaccacgaccuccgucgccaccgaggacauccaccgcaccuucaagccccugaucggcccccggccccucgugaacggccugcaggggcgcaucgacuacuacugggccgugcugaagccgggccagacgcuccggguccgcagcaacgggaaccugaucgcgcccugguacggccacauccugcucggcgagucccacgggcggauccugaagaccgaccucaagagcggcaacugcguggugcagugccagaccgagcgcgggggccugaacaccacgcugcccuuccacaacgucagcaaguacgccuucgggaacugccccaaguacaucggcgugaagucccugaagcucgccgugggccugcggaacgucccggcccgcagcucccgggggcuguucggcgccaucgcgggguucaucgagggcggguggagcggccucguggccggcugguacggguuccagcacuccaacgaccagggcaccgggauggccgccgaccgcgacagcacccagaaggccaucgacaagaucaccuccaaggugaacaacaucgucgacaagaugaacaagcaguacgagaucaucgaccacgaguucagcgagaucgagacgcggcugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgcgcccugggcuccaacgccguggaggacgggaagggcugcuucgaccucuaccacaagugcgacaaccagugcauggagaccauccggaacggcaccuacaaccgccgcaaguaccaggaggagagccggcuggagcgccagaagaucgagggggucaagcuggaguccgagggcacguacaagauccucaccaucuacagcaccguggcguccagccuggugaucgccaugggguucgccgccuuccuguucugggccauguccaacggcagcugccggugcaacaucugcaucuga

SEQ ID NO: 71311 - RNA, 1683 nt, Artificial Sequence
  derived and/or modified sequence opt1 from hemagglutinin__InfluenzaA__AGQ81157
auggaggccgccaccaucaucaccauccugcucgugaucacgggcaacaacgcggacaagaucugcaucggguaccagagcaccaacuccaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccagcugcgaccucccccuggagggccgggacugguccuacaucgucgagcgccccagcgccgugaacggcgugugcuacccggggaacgucgagaaccuggaggagcuccggucccuguucagcuccgccagcuccuaccagaagauccagaucuuccccgacagcaucuggaacguguccuacaacggcaccagcaaggcgugcuccgacagcuucuaccgcuccaugcgguggcugacccagaagaacaacaacuaccccgugcaggacgcccaguacaccaacaaccgcgggaagaacauccucuucauguggggcaucaaccacccgcccaccgacaccacgcagaccaaccuguacacccggaccgacacgaccaccagcgucgccaccgaggacaucaaccgcacguucaagccccugaucgggccccggccccucgugaacggccugcagggccgcaucgacuacuacugggccgugcugaagccggggcagacccuccggguccgcuccaacggcaaccugaucgcgcccugguacgggcacauccugcucggcgagagccacggccggauccugaagaccgaccugaaguccgggaacugcguggugcagugccagaccgagcgcggcgggcucaacacgacccugcccuuccacaacgucagcaaguacgccuucggcgacugccccaaguacaucggggucaagagccugaagcucgccgugggccugcggaacgugccggcccgcuccagccggggccuguucggggccaucgcgggcuucaucgagggcgggugguccgggcucguggccggcugguacggcuuccagcacagcaacgaccaggggaccggcauggccgccgaccgcgacuccacccagaaggccaucgacaagaucacgagcaaggugaacaacaucgucgacaagaugaacaagcaguacgagaucaucgaccacgaguucuccgagaucgagacccggcugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgcgcccuggggagcaacgccguggaggacggcaaggggugcuucgaccucuaccacaagugcgacaaccagugcauggagaccauccggaacggcacguacaaccgccgcaaguaccaggaggagucccggcuggagcgccagaagaucgagggcgucaagcuggagagcgaggggaccuacaagauccucaccaucuacuccaccguggcgagcucccuggugaucgccaugggcuucgccgccuuccuguucugggccaugagcaacggguccugccggugcaacaucugcaucuga

SEQ ID NO: 71312 - RNA, 1683 nt, Artificial Sequence
  derived and/or modified sequence opt1 from hemagglutinin__InfluenzaA__AGQ81158
auggagguggucaccaucaucaccauccugcucgugaucacgcgcagcaacgccgacaagaucugcaucggcuaccaguccaccaacagcaccgagaccguggacacgcugaccgagaacaacguccccgugacccacgccaaggagcugcuccacaccgagcacaacgggaugcugugcgcgacgaaccugggccggccgcucauccuggacacgugcaccaucgaggggcugaucuacggcaaccccuccugcgaccucccccuggaggggcgcgaguggagcuacaucguggagcggcccuccgccgucaacggcgugugcuacccgggcaacguggagaaccuggaggagcuccgcagccuguucuccagcgccuccagcuaccagcggauccagaucuuccccgacuccaucuggaacgucagcuacuccgggaccagcaaggccugcuccgacagcuucuaccgcuccaugcgguggcugacccagaagaacaacaacuaccccgugcaggacgcccaguacaccaacaaccgcggcaagaacauccucuucaugugggggaucaaccacccgcccaccgacaccgcgcagacgaaccuguacacccggaccgacaccacgaccagcguggccaccgaggacaucaaccgcaccuucaagccccugaucggcccccggccccucgucaacgggcugcagggccgcaucgacuacuacugggccgugcugaagccgggccagacgcuccgggugcgcuccaacgggaaccugaucgcccccugguacggccacauccugcucggggagagccacggccggauccugaagaccgaccucaagagcggcuccugcgucgugcagugccagaccgagcgcgggggccugaacaccacgcugcccuuccacaacgugagcaaguacgcguucgggaacugccccaaguacaucggcgucaagucccugaagcucgccguggggcugcggaacgugccggcccgcagcucccggggccuguucggcgccaucgccggguucaucgagggcggguggagcggccucgucgcggggugguacggcuuccagcacuccaacgaccagggcaccgggauggccgccgaccgcgacagcacccagaaggccaucgacaagaucaccuccaaggugaacaacaucguggacaagaugaacaagcaguacgagaucaucaaccacgaguucagcgagaucgagacgcggcugaacaugaucaacgacaagaucgacgaccagauccaggacaucugggccuacaacgcggagcugcucguccugcuggagaaccagaagacccucgacgagcacgacgccaacgugaacaaccuguacaacaaggucaagcgcgcccugggcuccaacgccguggaggacgggaagggcugcuucgaccucuaccacaagugcgacaaccagugcauggagaccauccgcaacgggaccuacaaccggcgcauguaccaggaggagagccggcuggagcgccagaagaucgagggcgugaagcuggaguccgagggcacguacaagauccucaccaucuacagcaccgucgccuccagccuggugaucgcgaugggguucgccgccuuccuguucugggccauguccaacggcagcugccggugcaacaucugcaucuga

SEQ ID NO: 71313 - RNA, 1683 nt, Artificial Sequence
  derived and/or modified sequence opt1 from hemagglutinin__InfluenzaA__AGQ81159
auggaggccgccaccaucaucaccauccugcucgugaucacgggcagcaacgcggacaagaucugcaucggguaccaguccaccaacagcaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggagcuacaucgucgagcgccccuccgccgugaacggcgugugcuacccggggaacgucgagaaccuggaggagcuccggagccuguucuccagcgccuccagcuaccagaagauccagaucuuccccgacuccaucuggaacgugagcuacgacggcaucuccaaggcgugcagcaacuccuucuaccgcagcaugcgguggcugaccaagaagaacaacuccuaccccgugcaggacgcccaguacaccaacaacaucgggaagaacauccucuucauguggggcaucaaccacccgcccaccaacaccacccagacggaccuguacacccgcaccgacaccacgaccagcgucgccaccgaggacauccaccggaccuucaagccccugaucgggccccggcccccggugaacggccuccugggccgcaucgacuacuacugggccgugcugaagcccgggcagacgcuccgcguccgguccaacggcaaccugaucgcgcccugguacgggcacauccugcucggcgagagccacggccgcauccugaagaccgaccucaagagcgggaacugcguggugcagugccagaccgagcggggcgggcugaacaccacgcugcccuuccacaacgucuccaaguacgccuucggcaacugcccgaaguacaucggggucaagagccugaagcucgccgugggccugcgcaacgugcccgcccgguccagccgcggccuguucggggccaucgcgggcuucaucgagggcgggugguccgggcucguggccggcugguacggcuuccagcacagcaacgaccaggggaccggcauggccgccgaccgggacuccacccagaaggccaucgacaagaucaccagcaaggugaacaacaucgucgacaagaugaacaagcaguacgagaucaucgaccacgaguucuccgagaucgagacgcgccugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgggcccuggggagcaacgccguggaggacggcaaggggugcuucgaccucuaccacaagugcgacaaccagugcauggagaccauccgcaacggcaccuacaaccggcgcaaguaccaggaggagucccgccuggagcggcagaagaucgagggcgucaagcuggagagcgaggggacguacaagauccucaccaucuacuccaccguggcgagcucccuggugaucgccaugggcuucgccgccuuccuguucugggccaugagcaacggguccugccgcugcaacaucugcaucuga

SEQ ID NO: 71314 - RNA, 1683 nt, Artificial Sequence
  derived and/or modified sequence opt1 from hemagglutinin__InfluenzaA__AGQ81161
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgacccccugcuggaggggcgcgaguggagcuacaucguggagcggcccuccgccgucaacggccucugcuacccgggcaacguggagaaccuggaggagcugcgcagccucuucuccagcgcccgguccuaccagcgcauccagaucuuccccgacaccaucuggaacgugagcuacgacgggaccuccaaggccugcagcggcuccuucuaccggaacaugcgcuggcugacccagaagaacagcgacuaccccauccaggacgcgcaguacaccaacaaccaggggaagaacauccuguucauguggggcaucaaccacccgcccaccgacacgacccagcgggaccucuacacccgcaccgacacgaccaccuccgucgccaccgaggagaucaaccggaucuucaagccccugaucgggccccgcccccuggugaacggccucaugggccggaucgacuacuacuggagcgugcugaagccggggcagacgcugcgcaucaaguccgacggcaaccucaucgcccccugguacgggcacauccugagcggcgagagccacggccggauccugaagaccgaccucaagaagggguccugcaccguccagugccagaccgagaagggcgggcugaacacgacccugcccuuccagaacgugagcaaguacgccuucggcaacugcuccaaguacaucgggaucaagagccucaagcuggcggugggccugcgcaacguccccucccggagcucccgcggccucuucggggccaucgccggcuucaucgagggcggguggagcgggcugguggccggcugguacggcuuccagcacuccaacgaccagggggugggcauggccgcggaccgggacagcacccagaaggccaucgacaagaucaccuccaaggucaacaacaucguggacaagaugaacaagcaguacgagaucaucgaccacgaguucagcgagguggagacgcgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggguccaacgccgucgaggacggcaaggggugcuucgagcuguaccacaagugcgacgaccagugcauggagaccauccgcaacggcaccuacaaccggcgcaaguaccaggaggagagcaagcuggagcgccagaagaucgagggcgugaagcucgaguccgaggggacguacaagauccugaccaucuacagcaccgucgccuccagccuggugaucgccaugggcuucgccgcguuccucuucugggccauguccaacgggagcugccggugcaacaucugcaucuga

SEQ ID NO: 71315 - RNA, 1683 nt, Artificial Sequence
  derived and/or modified sequence opt1 from hemagglutinin__InfluenzaA__AGQ81162
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacgacgggaccuccaaggccugcagcggcuccuucuaccggagcaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagaaggggagcugcaccguccagugccagaccgagaagggcgggcugaacacgacccuccccuuccagaacguguccaaguacgccuucggcaacugcagcaaguacaucgggaucaagucccugaagcuggcggugggccuccgcaacguccccagccgguccagccgcggccuguucggggccaucgccggcuucaucgagggcgggugguccgggcugguggccggcugguacggcuuccagcacagcaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggagcaacgccgucgaggacggcaaggggugcuucgagcuguaccacaagugcgacgaccagugcauggagaccauccgcaacggcaccuacaaccggaagaaguaccaggaggaguccaagcucgagcgccagaagaucgagggcgugaagcuggagagcgaggggacguacaagauccugaccaucuacuccaccgucgccagcucccucgugaucgccaugggcuucgccgcguuccuguucugggccaugagcaacgggagcugccgcugcaacaucugcaucuga

SEQ ID NO: 71316 - RNA, 1683 nt, Artificial Sequence
  derived and/or modified sequence opt1 from hemagglutinin__InfluenzaA__AGQ81164
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacgacgggaccuccaaggccugcagcggcuccuucuaccggagcaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagaaggggagcugcaccguccagugccagaccgagaagggcgggcugaacacgacccuccccuuccagaacguguccaaguacgccuucggcaacugcagcaaguacaucgggaucaagucccugaagcuggcggugggccuccgcaacguccccagccgguccagccgcggccuguucggggccaucgccggcuucaucgagggcgggugguccgggcugguggccggcugguacggcuuccagcacagcaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggagcaacgccgucgaggacggcaaggggugcuucgagcuguaccacaagugcgacgaccagugcauggagaccauccgcaacggcaccuacaaccggcgcaaguaccaggaggaguccaagcucgagcgccagaagaucgagggcgugaagcuggagagcgaggggacguacaagauccugaccaucuacuccaccgucgccagcucccucgugaucgccaugggcuucgccgcguuccuguucugggccaugagcaacgggagcugccggugcaacaucugcaucuga

SEQ ID NO: 71317 - RNA, 1683 nt, Artificial Sequence
  derived and/or modified sequence opt1 from hemagglutinin__InfluenzaA__AGQ81167
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacaacgggaccuccaaggccugcagcggcuccuucuaccggagcaugcgcuggcugacccagaagaacuccaacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagaaggggagcugcaccguccagugccagaccgagaagggcgggcugaacacgacccuccccuuccagaacguguccaaguacgccuucggcaacugcagcaaguacaucgggaucaagucccugaagcuggcggugggccuccgcaacguccccagccgguccagccgcggccuguucggggccaucgccggcuucaucgagggcgggugguccgggcugguggccggcugguacggcuuccagcacagcaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggagcaacgccgucgaggacggcaaggggugcuucgagcuguaccacaagugcgacgaccagugcauggagaccauccgcaacggcaccuacaaccggcgcaaguaccaggaggaguccaagcucgagcgccagaagaucgagggcgugaagcuggagagcgaggggacguacaagauccugaccaucuacuccaccgucgccagcucccucgugaucgccaugggcuucgccgcguuccuguucugggccaugagcaacgggagcugccggugcaacaucugcaucuga

SEQ ID NO: 71318 - RNA, 1683 nt, Artificial Sequence
  derived and/or modified sequence opt1 from hemagglutinin__InfluenzaA__AGQ81168
auggagaccgugagccugaucaccauccuccuggucgugacgguguccaacgccgacaagaucugcaucggcuaccagagcaccaacuccaccgagaccgucgacacgcugaccgagaacaacgugcccgugacccacgcccgcgagcuccugcacaccgagcacaacgggaugcugugcgcgacgagccucggccacccgcugauccuggacacgugcaccaucgaggggcucaucuacggcaaccccuccugcgaccugcugcucgggggccgggaguggagcuacaucgucgagcgccccuccgccgugaacggccugugcuaccccgggaacguggagaaccuggaggagcuccggagccuguucuccagcgcccgcuccuaccagcggauccagaucuucccggacaccaucuggaacgucagcuacuccggcaccagcaaggccugcuccgacagcuucuaccgcuccaugcgguggcugacccagaaggggaacgccuaccccauccaggacgcgcaguacaccaacaaccagggcaagaacauccucuucaugugggggaucaaccacccgcccaccgacacggcccagaccaaccuguacacccgcaccgacacgaccaccagcguggccaccgaggagaucaaccggacguucaagccccugaucggcccccgcccccucgugaacggccugauggggcggaucaacuacuacugguccguccugaagcccggccagacccuccgcaucaagagcaacgggaaccugaucgccccgugguacggccacauccugagcggcgagucccacgggcggauccucaagaccgaccugaagcgcggcagcugcaccgugcagugccagacggagaagggcgggcugaacaccacccuccccuuccagaacguguccaaguacgcguucgggaacugcagcaaguacaucggcaugaagucccugaagcuggccgucggccuccggaacgugcccagccgcuccagccgggggcuguucggcgccaucgccggguucaucgagggcgggugguccggccugguggccggcugguacggguuccagcacagcaacgaccagggcgucgggauggcggccgaccgcgacuccacccagaaggccaucgacaagaucacgagcaaggugaacaacaucguggacaagaugaacaagcaguacgagaucaucgaccacgaguucuccgaggucgagacccggcucaacaugaucaacaacaagaucgacgaccagauccaggacaucugggccuacaacgccgagcugcuggugcuccuggagaaccagaagacccuggacgagcacgacgcgaacgugaacaaccucuacaacaaggucaagcgcgcccugggcagcaacgccguggaggacgggaagggcugcuucgagcuguaccacaagugcgacgaccagugcauggagaccauccggaacggcacguacaaccgccgcaaguaccaggaggaguccaagcucgagcggcagaagaucgagggggucaagcuggagagcgagggcaccuacaagauccugaccaucuacuccaccguggccagcucccucgugaucgccaugggguucgcggccuuccuguucugggccaugagcaacggcagcugccgcugcaacaucugcaucuga

SEQ ID NO: 71319 - RNA, 1683 nt, Artificial Sequence
  derived and/or modified sequence opt1 from hemagglutinin__InfluenzaA__AGQ81169
auggagaccgugagccugaucaccauccuccuggucgugacgguguccaacgccgacaagaucugcaucggcuaccagagcaccaacuccaccgagaccgucgacacgcugaccgagaacaacgugcccgugacccacgcccgcgagcuccugcacaccgagcacaacgggaugcugugcgcgacgagccucggccacccgcugauccuggacacgugcaccaucgaggggcucaucuacggcaaccccuccugcgaccugcugcucgggggccgggaguggagcuacaucgucgagcgccccuccgccgugaacggccugugcuaccccgggaacguggagaaccuggaggagcuccggagccuguucuccagcgcccgcuccuaccagcggauccagaucuucccggacaccaucuggaacgucagcuacuccggcaccagcaaggccugcuccgacagcuucuaccgcuccaugcgguggcugacccagaaggacaacgccuaccccauccaggacgcgcaguacaccaacaaccaggagaagaacauccucuucaugugggggaucaaccacccgcccaccgacacggugcagaccaaccuguacacccgcaccgacacgaccaccagcguggccaccgaggagaucaaccggacguucaagccccugaucggcccccgcccccucgucaacgggcugaugggccggaucaacuacuacugguccgugcugaagcccggccagacccuccgcaucaagagcaacgggaaccugaucgccccgugguacggccacauccugagcggggagucccacggccggauccucaagaccgaccugaagcgcggcagcugcaccgugcagugccagacggagaagggcgggcugaacaccacccuccccuuccagaacgucuccaaguacgccuucgggaacugcagcaaguacaucggcaugaagucccugaagcuggcgguggggcuccggaacgugcccagccgcuccagccggggccuguucggcgccaucgccggguucaucgagggcgggugguccggccuggucgccgggugguacggcuuccagcacagcaacgaccagggcguggggauggccgcggaccgcgacuccacccagaaggccaucgacaagaucacgagcaaggugaacaacaucgucgacaagaugaacaagcaguacgagaucaucgaccacgaguucuccgagguggagacccggcucaacaugaucaacaacaagaucgacgaccagauccaggacaucugggccuacaacgccgagcugcuggugcuccuggagaaccagaagacccuggacgagcacgacgccaacgucaacaaccucuacaacaaggugaagcgcgcgcugggcagcaacgccgucgaggacgggaagggcugcuucgagcuguaccacaagugcgacgaccagugcauggagaccauccggaacgggacguacaaccgccgcaaguaccaggaggaguccaagcucgagcggcagaagaucgagggcgugaagcuggagagcgagggcaccuacaagauccugaccaucuacuccaccguggccagcucccucgucaucgccaugggguucgccgcguuccuguucugggccaugagcaacggcagcugccgcugcaacaucugcaucuga

SEQ ID NO: 71320 - RNA, 1683 nt, Artificial Sequence
  derived and/or modified sequence opt1 from hemagglutinin__InfluenzaA__AGQ81170
auggagaccgugagccugaucaccauccuccuggucgugacgguguccaacgccgacaagaucugcaucggcuaccagagcaccaacuccaccgagaccgucgacacgcugaccgagaacaacgugcccgugacccacgcccgcgagcuccugcacaccgagcacaacgggaugcugugcgcgacgagccucggccacccgcugauccuggacacgugcaccaucgaggggcucaucuacggcaaccccuccugcgaccugcugcucgggggccgggaguggagcuacaucgucgagcgccccuccgccgugaacggccugugcuaccccgggaacguggagaaccuggaggagcuccggagccuguucuccagcgcccgcuccuaccagcggauccagaucuucccggacaccaucuggaacgucagcuacuccggcaccagcaaggccugcuccgacagcuucuaccgcuccaugcgguggcugacccagaaggacaacgccuaccccauccaggacgcgcaguacaccaacaaccaggggaagaacauccucuucauguggggcaucaaccacccgcccaccgacacggcccagaccaaccuguacacccgcaccgacacgaccaccagcguggccaccgaggagaucaaccggacguucaagccccugaucgggccccgcccccucgugaacggccugaugggccggaucaacuacuacugguccguccugaagcccgggcagacccuccgcaucaagagcaacggcaaccugaucgccccgugguacgggcacauccugagcggcgagucccacggccggauccucaagaccgaccugaagcgcgggagcugcaccgugcagugccagacggagaagggcgggcugaacaccacccuccccuuccagaacguguccaaguacgcguucggcaacugcagcaaguacaucgggaugaagucccugaagcuggccgucggccuccggaacgugcccagccgcuccagccggggccuguucggggccaucgccggcuucaucgagggcgggugguccgggcugguggccggcugguacggcuuccagcacagcaacgaccagggggucggcauggcggccgaccgcgacuccacccagaaggccaucgacaagaucacgagcaaggugaacaacaucguggacaagaugaacaagcaguacgagaucaucgaccacgaguucuccgaggucgagacccggcucaacaugaucaacaacaagaucgacgaccagauccaggacaucugggccuacaacgccgagcugcuggugcuccuggagaaccagaagacccuggacgagcacgacgcgaacgugaacaaccucuacaacaaggucaagcgcgcccuggggagcaacgccguggaggacggcaaggggugcuucgagcuguaccacaagugcgacgaccagugcauggagaccauccggaacggcacguacaaccgccgcaaguaccaggaggaguccaagcucgagcggcagaagaucgagggcgucaagcuggagagcgaggggaccuacaagauccugaccaucuacuccaccguggccagcucccucgugaucgccaugggcuucgcggccuuccuguucugggccaugagcaacgggagcugccgcugcaacaucugcaucuga

SEQ ID NO: 71321 - RNA, 1683 nt, Artificial Sequence; identical to SEQ ID NO: 71320
  derived and/or modified sequence opt1 from hemagglutinin__InfluenzaA__AGQ81171

SEQ ID NO: 71322 - RNA, 1683 nt, Artificial Sequence; identical to SEQ ID NO: 71320
  derived and/or modified sequence opt1 from hemagglutinin__InfluenzaA__AGQ81172

SEQ ID NO: 71323 - RNA, 1683 nt, Artificial Sequence
  derived and/or modified sequence opt1 from hemagglutinin__InfluenzaA__AGQ81173
auggagaccgccagccugaucaccauccuccugguggucacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggcaacccgcugauccuggacacgugcaccaucgaggggcucaucuacggcaaccccuccugcgaccugcugcucgggggccgcgaguggagcuacaucguggagcggcccuccgccgucaacggccugugcuaccccgggaacguggagaaccuggaggagcuccgcagccuguucuccagcgcccgguccuaccagcgcauccagaucuucccggacaccaucuggaacgugagcuacuccggcaccagcaaggccugcuccgacagcuucuaccgguccaugcgcuggcugacccagaaggacaacgcguaccccauccaggacgcccaguacaccaacaaccaggggaagaacauccucuucauguggggcaucaaccacccgcccaccgacacggcccagaccaaccuguacacccggaccgacacgaccaccagcgucgccaccgaggagaucaaccgcacguucaagccccugaucgggccccggccccucgugaacggccugaugggccgcaucaacuacuacugguccgugcugaagcccgggcagacccuccggaucaagagcaacggcaaccugaucgcgccgugguacgggcacauccugagcggcgagucccacggccgcauccucaagaccgaccugaagcgggggagcugcaccguccagugccagacggagaagggcgggcugaacaccacccuccccuuccagaacguguccaaguacgccuucggcaacugcagcaaguacaucgggaugaagucccugaagcuggccgugggccuccgcaacguccccagccgguccagccgcggccuguucggggccaucgccggcuucaucgagggcgggugguccgggcugguggcgggcugguacggcuuccagcacagcaacgaccagggggugggcauggccgccgaccgggacuccacccagaaggccaucgacaagaucacgagcaaggucaacaacaucguggacaagaugaacaagcaguacgagaucaucgaccacgaguucuccgagguggagacccgccucaacaugaucaacaacaagaucgacgaccagauccaggacaucugggccuacaacgcggagcugcugguccuccuggagaaccagaagacccuggacgagcacgacgccaacgugaacaaccucuacaacaaggugaagcgggcccuggggagcaacgccgucgaggacggcaaggggugcuucgagcuguaccacaagugcgacgaccagugcauggagaccauccgcaacggcacguacaaccggcgcaaguaccaggaggaguccaagcucgagcgccagaagaucgagggcgugaagcuggagagcgaggggaccuacaagauccugaccaucuacuccaccgucgccagcucccucgugaucgcgaugggcuucgccgccuuccuguucugggccaugagcaacgggagcugccggugcaacaucugcaucuga

SEQ ID NO: 71324 - RNA, 1683 nt, Artificial Sequence; identical to SEQ ID NO: 71320
  derived and/or modified sequence opt1 from hemagglutinin__InfluenzaA__AGQ81175

SEQ ID NO: 71325 - RNA, 1683 nt, Artificial Sequence
  derived and/or modified sequence opt1 from hemagglutinin__InfluenzaA__AGQ81177
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacaacgggaccuccaaggccugcagcggcuccuucuaccggagcaugcgcuggcugacccggaagaacggggacuaccccauccaggacgcgcaguacaccaacaaccagggcaagaacauccucuucaugugggggaucaaccacccgcccaccgacacgacccagcgcgaccuguacacccggaccgacacgaccaccuccgucgccaccgaggagaucaaccgcaucuucaagccccugaucggcccccggccccucgugaacggccugauggggcgcaucgacuacuacuggagcgugcugaagcccggccagacgcuccggaucaaguccgacgggaaccugaucgccccgugguacggccacauccugagcggcgagagccacgggcgcauccucaagaccgaccugaagcggggcuccugcaccguccagugccagaccgagaagggcgggcugaacacgacccuccccuuccagaacgugagcaaguacgccuucgggaacugcuccaaguacaucggcaucaagagccugaagcuggcggugggccuccgcaacguccccucccggagcucccgcgggcuguucggcgccaucgccggguucaucgagggcggguggagcggccugguggccggcugguacggguuccagcacuccaacgaccagggcguggggauggccgcggaccgggacagcacccagaaggccaucgacaagaucaccuccaaggucaacaacaucguggacaagaugaacaagcaguacgagaucaucgaccacgaguucagcgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcugggcuccaacgccgucgaggacgggaagggcugcuucgagcuguaccacaagugcgacgaccagugcauggagaccauccgcaacggcaccuacaaccgccggaaguaccaggaggagagcaagcucgagcgccagaagaucgagggggugaagcuggaguccgagggcacguacaagauccugaccaucuacagcaccgucgccuccagccucgugaucgccaugggguucgccgcguuccuguucugggccauguccaacggcagcugccggugcaacaucugcaucuga

SEQ ID NO: 71326 - RNA, 1683 nt, Artificial Sequence; identical to SEQ ID NO: 71325
  derived and/or modified sequence opt1 from hemagglutinin__InfluenzaA__AGQ81178

SEQ ID NO: 71327 - RNA, 1683 nt, Artificial Sequence; identical to SEQ ID NO: 71317
  derived and/or modified sequence opt1 from hemagglutinin__InfluenzaA__AGQ81181

SEQ ID NO: 71328 - RNA, 1683 nt, Artificial Sequence; identical to SEQ ID NO: 71317
  derived and/or modified sequence opt1 from hemagglutinin__InfluenzaA__AGQ81183

SEQ ID NO: 71329 - RNA, 1683 nt, Artificial Sequence; identical to SEQ ID NO: 71316
  derived and/or modified sequence opt1 from hemagglutinin__InfluenzaA__AGQ81184

SEQ ID NO: 71330 - RNA, 1683 nt, Artificial Sequence
  derived and/or modified sequence opt1 from hemagglutinin__InfluenzaA__AGQ81185
auggagaccgccagccugaucaccauccuccugguggccacggucuccaacgcggacaagaucugcaucggcuaccagagcaccaacuccaccgagaccguggacacgcugaccgagaacaacgugcccgucacccacgccaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgugaacggccugugcuaccccggcaacgucgagaaccuggaggagcuccgcagccuguucuccagcgcccgguccuaccagcgcauccagaucuucccggacaccaccuggaacgugagcuacaacgggaccuccaaggcgugcagcggcuccuucuaccggagcaugcgcuggcugacccagaagaacuccaacuaccccauccaggacgcccaguacaccaacaaccaggggaagaacauccucuucauguggggcaucaaccacccgcccacggacaccacccagcgggaccuguacacccgcacggacaccaccaccagcguggccacggaggagaucaaccggaucuucaagccccugaucgggccccgcccccucgucaacggccugaugggccggaucgacuacuacugguccgugcugaagcccgggcagacccuccgcaucaagagcgacggcaaccugaucgccccgugguacgggcacauccugagcggcgagucccacggccggauccucaagaccgaccugaagcgcgggagcugcaccgugcagugccagacggagaagggcgggcugaacaccacccuccccuuccagaacgucuccaaguacgcguucggcaacugcagcaaguacaucgggaucaagucccugaagcuggccgugggccuccggaacgugcccagccgcuccagccggggccuguucggggccaucgccggcuucaucgagggcgggugguccgggcuggucgccggcugguacggcuuccagcacagcaacgaccagggggugggcauggcggccgaccgcgacuccacccagaaggccaucgacaagaucacgagcaaggugaacaacaucgucgacaagaugaacaagcaguacgagaucaucgaccacgaguucuccgagguggagacccggcucaacaugaucaacaacaagaucgacgaccagauccaggacaucugggccuacaacgccgagcugcuggugcuccuggagaaccagaagacccuggacgagcacgacgcgaacgucaacaaccucuacaacaaggugaagcgcgcccuggggagcaacgccguggaggacggcaaggggugcuucgagcuguaccacaagugcgacaaccagugcauggagaccauccggaacggcacguacaaccgccgcaaguaccaggaggaguccaagcucgagcggcagaagaucgagggcgucaagcuggagagcgaggggaccuacaagauccugaccaucuacuccaccguggccagcucccucgucaucgccaugggcuucgcggccuuccuguucugggccaugagcaacgggagcugccgcugcaacaucugcaucuga

SEQ ID NO: 71331 - RNA, 1683 nt, Artificial Sequence
  derived and/or modified sequence opt1 from hemagglutinin__InfluenzaA__AGQ81186
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacgacgggaccuccaaggccugcagcggcuccuucuaccggagcaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagaaggggagcugcaccguccagugccagaccgagaagggcgggcugaacacgacccuccccuuccagaacguguccaaguacgccuucggcaacugcagcaaguacaucgggaucaagucccugaagcuggcgaucggccuccgcaacgugcccagccgguccagccgcggccuguucggggccaucgccggcuucaucgagggcgggugguccgggcuggucgccggcugguacggcuuccagcacagcaacgaccagggggugggcauggccgcggaccgggacuccacccagaaggccaucgacaagaucaccagcaaggugaacaacaucgucgacaagaugaacaagcaguacgagaucaucgaccacgaguucuccgagguggagacgcgccucaacaugaucaacaacaagaucgacgaccagauccaggacaucugggccuacaacgccgagcugcuggugcuccuggagaaccagaagacccuggacgagcacgacgccaacgucaacaaccucuacaacaaggugaagcgggcgcuggggagcaacgccguggaggacggcaaggggugcuucgagcuguaccacaagugcgacgaccagugcauggagaccauccgcaacggcaccuacaaccggaagaaguaccaggaggaguccaagcucgagcgccagaagaucgagggcgucaagcuggagagcgaggggacguacaagauccugaccaucuacuccaccguggccagcucccucgucaucgccaugggcuucgccgcguuccuguucugggccaugagcaacgggagcugccgcugcaacaucugcaucuga

SEQ ID NO: 71332 - RNA, 1683 nt, Artificial Sequence; identical to SEQ ID NO: 71320
  derived and/or modified sequence opt1 from hemagglutinin__InfluenzaA__AGQ81190

SEQ ID NO: 71333 - RNA, 1683 nt, Artificial Sequence; identical to SEQ ID NO: 71320
  derived and/or modified sequence opt1 from hemagglutinin__InfluenzaA__AGQ81191

SEQ ID NO: 71334 - RNA, 1683 nt, Artificial Sequence; identical to SEQ ID NO: 71325
  derived and/or modified sequence opt1 from hemagglutinin__InfluenzaA__AGQ81192

SEQ ID NO: 71335 - RNA, 1683 nt, Artificial Sequence
  derived and/or modified sequence opt1 from hemagglutinin__InfluenzaA__AGQ81193
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacaccgggaccuccaaggccugcagcggcuccuucuaccggagcaugcgcuggcugacccagaagaacggggacuaccccauccaggacgcgcaguacaccaacaaccagggcaagaacauccucuucaugugggggaucaaccacccgcccacggacaccacccagcgggaccuguacacccgcacggacaccaccaccuccgucgccacggaggagaucaaccggaucuucaagccccugaucggcccccgcccccucgugaacggccugauggggcggaucgacuacuacuggagcgugcugaagcccggccagacccuccgcaucaaguccgacgggaaccugaucgccccgugguacggccacguccugagcggcgagagccacgggcggauccucaagaccgaccugaagcgcggcuccugcaccgugcagugccagacggagaagggcgggcugaacaccacccuccccuuccagaacgugagcaaguacgccuucgggaacugcuccaaguacaucggcaucaagagccugaagcuggcggucggccuccggaacgugcccucccgcagcucccgggggcuguucggcgccaucgccggguucaucgagggcggguggagcggccugguggccggcugguacggguuccagcacuccaacgaccagggcgucgggauggccgcggaccgcgacagcacccagaaggccaucgacaagaucacguccaaggugaacaacaucguggacaagaugaacaagcaguacgagaucaucgaccacgaguucagcgaggucgagacccggcucaacaugaucaacaacaagaucgacgaccagauccaggacaucugggccuacaacgccgagcugcuggugcuccuggagaaccagaagacccuggacgagcacgacgccaacgugaacaaccucuacaacaaggucaagcgcgcgcugggcuccaacgccguggaggacgggaagggcugcuucgagcuguaccacaagugcgacgaccagugcauggagaccauccggaacggcacguacaaccgccgcaaguaccaggaggagagcaagcucgagcggcagaagaucgagggggucaagcuggaguccgagggcaccuacaagauccugaccaucuacagcaccguggccuccagccucgugaucgccaugggguucgccgcguuccuguucugggccauguccaacggcagcugccgcugcaacaucugcaucuga

SEQ ID NO: 71336 - RNA, 1683 nt, Artificial Sequence; identical to SEQ ID NO: 71320
  derived and/or modified sequence opt1 from hemagglutinin__InfluenzaA__AGQ81194

SEQ ID NO: 71337 - RNA, 1686 nt, Artificial Sequence
  derived and/or modified sequence opt1 from hemagglutinin__InfluenzaA__AGQ81195
auguacaagaucguggucaucaucacccugcucggcaccgugaaggggcuggacaagaucugccugggccaccacgccguggccaacgggacgaucgucaagacccucaccaacgagcaggaggaggugaccaacgcgacggagaccguggagggcaagagccugaaccgccugugcaugaaggggcggaaccacaaggaccucggcaacugccaccccaucggcaugcugaucgggaccccggccugcgaccugcaccucaccggcacgugggacacccugaucgagcgcgagaacgccaucgccuacugcuaccccggggccaccaucaacgaggaggcgcugcggcagaagaucauggaguccggcgggaucagcaagaucuccaccggcuucacguacggcagcuccaucaacagcgccgggaccacccgcgccugcaugcggaacggcgggaacuccuucuacgccgagcucaaguggcuggucagcaaguccaagggccagaacuucccccagaccacgaacaccuaccgcaacaccgacaccagcgagcaccugaucauguggggcauccaccaccccuccagcacgcaggagaagaacgaccucuacgggacccagucccugagcaucuccgugggcagcuccaccuaccagaacaacuucgugccggucgugggggcgcggccccaggugaacggccagagcgggcgcaucgacuuccacuggacccugguccagcccggcgacaacaucacguucucccacaacggcgggcucaucgcccccagccgggugagcaagcugaucggccgcgggcugggcauccaguccgacgccagcaucgacaacaacugcgaguccaagugcuucuggcgcgggggcagcaucaacacccggcucccguuccagaaccugagcccccggaccgugggccagugccccaaguacgucaacaagcgcucccugaugcucgccaccgggaugcggaacgugcccgagaucaugcagggccgcgggcuguucggcgccaucgcgggguucaucgagaacggcugggagggcaugguggacgggugguacggcuuccggcaccagaacgcccaggggacgggccaggccgccgacuacaaguccacccaggccgcgaucgaccagaucaccggcaagcugaaccgccucaucgagaagaccaacacggaguucgagagcaucgaguccgaguucagcgagaucgagcaccagaucgggaacgucaucaacuggaccaaggacuccaucaccgacaucuggaccuaccaggccgagcugcugguggccauggagaaccagcacacgaucgacauggccgacagcgagaugcucaaccuguacgagcgggugcgcaagcagcugcggcagaacgccgaggaggacggcaaggggugcuucgagaucuaccacgcgugcgacgacuccugcauggagagcauccgcaacaacaccuacgaccacucccaguaccgcgaggaggcccuccugaaccggcugaacaucaacccggucacccucagcuccggcuacaaggacaucauccugugguucagcuucggggccuccugcuucgugcugcucgccguggucaugggccugguguucuucugccugaagaacggcaacaugcgcugcaccaucugcaucuga

SEQ ID NO: 71338 - RNA, 1686 nt, Artificial Sequence
  derived and/or modified sequence opt1 from hemagglutinin__InfluenzaA__AGQ81196
auguacaagaucguggucaucaucgcccugcucggcgccgugaaggggcuggacaagaucugccugggccaccacgcgguggccaacgggaccaucgucaagacccucacgaacgagcaggaggaggugaccaacgccaccgagaccguggagagcgccucccugaaccgccugugcaugaagggccggagccacaaggaccucgggaacugccaccccaucggcaugcugaucggcacgccggccugcgaccugcaccucaccgggaccugggacacccugaucgagcgcgagaacgcgaucgccuacugcuaccccggcgccacggucaacgaggaggcccugcggcagaagaucauggaguccgggggcaucagcaagaucuccaccggguucaccuacggcagcuccaucaacagcgcgggcaccacgaaggccugcaugcgcaaccgggggaacuccuucuacgccgagcucaaguggcuggugagcaaguccaagggccagaacuucccccagaccaccaacaccuaccgcaacacggacaccgccgagcaccugaucaugugggggauccaccaccccagcuccacccaggagaagaacgaccucuacggcacccagagccuguccaucagcgugggcuccagcacguaccagaacaacuucgucccgguggugggggcccggccccaggucaacggccaguccgggcgcaucgacuuccacuggacccuggugcagcccggcgacaacaucaccuucagccacaacgggggccucaucgcgcccagccggguguccaagcuggucggccgcgggcugggcauccagagcgacgccccgaucgacaacaacugcgaguccaagugcuucuggcgcgggggcagcaucaacacccggcuccccuuccagaaccugagcccccggacgguggggcagugccccaaguacgugaacaagcgcucccugaugcucgccaccggcaugcggaacgucccggagaucaugcagggccgcgggcuguucggcgccaucgccggguucaucgagaacggcugggaggggaugguggacggcugguacggcuuccggcaccagaacgcgcaggggaccggccaggccgccgacuacaaguccacccagacggccaucgaccagaucaccgggaagcugaaccgccucaucgagaagaccaacaccgaguucgagagcaucgaguccgaguucagcgagaucgagcaccagaucggcaacgugaucaacuggacgaaggacuccaucaccgacaucuggaccuaccaggccgagcugcuggucgcgauggagaaccagcacaccaucgacauggccgacagcgagaugcucaaccuguacgagcgggugcgcaagcagcugcggcagaacgccgaggaggacggcaaggggugcuucgagaucuaccacgccugcgacgacuccugcauggagagcauccgcaacaacacguacgaccacucccaguaccgcgaggaggcccuccugaaccggcugaacaucaaccccgugaagcucagcuccggcuacaaggacaucauccugugguucagcuucggggcguccugcuucguccugcucgccguggucaugggccugguguucuucugccugaagaacgggaacaugcgcugcaccaucugcaucuga

SEQ ID NO: 71339 - RNA, 1686 nt, Artificial Sequence
  derived and/or modified sequence opt1 from hemagglutinin__InfluenzaA__AGQ81198
auguacaagaucguggucaucaucgcccugcucggcgccgugaaggggcuggacaagaucugccugggccaccacgcgguggccaacgggaccaucgucaagacccucacgaacgagcaggaggaggugaccaacgccaccgagaccguggagagcacgucccugaaccgccugugcaugaagggccggaaccacaaggaccucgggaacugccaccccaucggcaugcugaucggcaccccggccugcgaccugcaccucaccgggaccugggacacgcugaucgagcgcgagaacgccaucgcguacugcuaccccggcgccaccaucaacgaggaggcccugcggcagaagaucauggagagcgggggcaucuccaagaucagcaccggguucaccuacggcuccagcaucaacuccgccggcaacacgaaggcgugcaugcgcaacgggggcaacagcuucuacgccgagcuccgguggcuggucuccaagaacaaggggcagaacuucccccagaccaccaacaccuaccgcaacacggacaccgccgagcaccugaucaucuggggcauccaccaccccagcuccaccaaggagaagaacgaccucuacggcacccagagccuguccaucagcgugggguccagcacguaccagaacaacuucgugccggucgugggcgcccggccccaggugaacgggcaguccggccgcaucgacuuccacuggacccugguccagcccggggacaacaucaccuucagccacaacggcggccucaucgcccccucccgggugagcaagcugaucgggcgcggccuggggauccagagcgacgcgccgaucgacaacaacugcgaguccaagugcuucuggcggggcgggagcaucaacacccgccuccccuuccagaaccugagcccccggacggugggccagugccccaaguacgucaacaagaagucccugaugcucgccaccggcaugcgcaacgugccggagaucaugcaggggcggggccuguucggggccaucgccggcuucaucgagaacgggugggagggcaugguggacggcugguacggguuccgccaccagaacgcccagggcaccgggcaggcggccgacuacaaguccacccaggccgccaucgaccagaucacgggcaagcugaaccggcucaucgagaagaccaacaccgaguucgagagcaucgaguccgaguucagcgagaucgagcaccagaucggcaacgucaucaacuggaccaaggacuccaucacggacaucuggaccuaccaggccgagcugcugguggcgauggagaaccagcacaccaucgacauggccgacagcgagaugcucaaccuguacgagcgcgugcggaagcagcugcgccagaacgccgaggaggacgggaagggcugcuucgagaucuaccacgccugcgacgacuccugcauggagagcauccggaacaacaccuacgaccacucccaguaccgcgaggaggcccuccugaaccgccugaacaucaaccccgucacgcucagcuccggguacaaggacaucauccugugguucagcuucggcgcguccugcuucgugcugcucgccguggucauggggcugguguucuucugccugaagaacggcaacaugcggugcaccaucugcaucuga

SEQ ID NO: 71340 - RNA, 1686 nt, Artificial Sequence
  derived and/or modified sequence opt1 from hemagglutinin__InfluenzaA__AGQ81199
auguacaagaucguggucaucaucgcccugcucggcgccgugaaggggcuggacaagaucugccugggccaccacgcgguggccaacgggaccaucgucaagacccucacgaacgagcaggaggaggugaccaacgccaccgagaccguggagagcgccucccugaaccgccugugcaugaagggccggagccacaaggaccucgggaacugccaccccaucggcaugcugaucggcacgccggccugcgaccugcaccucaccgggaccugggacacccugaucgagcgcgagaacgcgaucgccuacugcuaccccggcgccacggucaacgaggaggcccugcggcagaagaucauggaguccgggggcaucagcaagaucuccaccggguucaccuacggcagcuccaucaacagcgcgggcaccacgaaggccugcaugcgcaacgggggcaacuccuucuacgccgagcucaaguggcuggugagcaaguccaaggggcagaacuucccccagaccaccaacaccuaccggaacacggacaccgccgagcaccugaucauguggggcauccaccaccccagcuccacccaggagaagaacgaccucuacggcacccagagccuguccaucagcgugggguccagcacguaccagaacaacuucgucccgguggugggcgcccgcccccaggucaacgggcaguccggccggaucgacuuccacuggacccuggugcagcccggggacaacaucaccuucagccacaacggcggccucaucgcgcccagccgcguguccaagcuggucgggcggggccuggggauccagagcgacgccccgaucgacaacaacugcgaguccaagugcuucuggcgcggcgggagcaucaacacccggcuccccuuccagaaccugagcccccgcacggugggccagugccccaaguacgugaacaagcggucccugaugcucgccaccggcaugcgcaacgucccggagaucaugcaggggcggggccuguucggggccaucgccggcuucaucgagaacgggugggagggcaugguggacggcugguacggguuccgccaccagaacgcgcagggcaccgggcaggccgccgacuacaaguccacccagacggccaucgaccagaucaccggcaagcugaaccggcucaucgagaagaccaacaccgaguucgagagcaucgaguccgaguucagcgagaucgagcaccagaucggcaacgugaucaacuggacgaaggacuccaucaccgacaucuggaccuaccaggccgagcugcuggucgcgauggagaaccagcacaccaucgacauggccgacagcgagaugcucaaccuguacgagcgcgugcggaagcagcugcgccagaacgccgaggaggacgggaagggcugcuucgagaucuaccacgccugcgacgacuccugcauggagagcauccggaacaacacguacgaccacucccaguaccgcgaggaggcccuccugaaccgccugaacaucaaccccgugaagcucagcuccggguacaaggacaucauccugugguucagcuucggcgcguccugcuucguccugcucgccguggucauggggcugguguucuucugccugaagaacggcaacaugcggugcaccaucugcaucuga

SEQ ID NO: 71341 - RNA, 1698 nt, Artificial Sequence
  derived and/or modified sequence opt1 from hemagglutinin__InfluenzaA__AGQ81200
augaagaagacccuccuguucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucgggcugggcgacugcagcuucgccggguggauccugggcaacccgaugugcgacgaccucaucggcaagaccuccuggagcuacaucguggagaagcccaaccccgccaacgggaucugcuaccccggcacccuggagaacgaggaggagcugcgccucaaguucuccgggguccuggaguucagcaaguucgaggccuucaccuccacgggcuggggcgccgugaacagcggggcgggcgugaccgccgccugcaaguucggguccagcaacuccuucuuccggaacauggucuggcugauccaccagagcggcaccuacccggugaucaagcgcaccuucaacaacacgaaggggcgggacgugcucgucguguggggcauccaccaccccgccacccugaaggagcaccaggaccuguacaagaaggacuccagcuacguggcggucggcuccgagaccuacaaccgccgguucauccccgagaucagcacccgccccaaggugaacgggcaggccggccggaugacguucuacuggaccaucgugaagccgggggagagcaucaccuucgaguccaacggcgccuuccucgcgccccgcuacgccuucgagaucgucagcguggggaacggcaagcuguuccgguccgagcugaacaucgagagcugcuccaccaagugccagacggagaucggcgggaucaacaccaacaagagcuuccacuccgugcaccgcaacaccaucggcgacugccccaaguacgucaacgucaagagccucaagcuggccaccgggcugcggaacgugcccgccaucgccucccgcggccucuucggggccaucgccggcuucaucgagggcggguggccgggccugaucaacgggugguacggcuuccagcaccggaacgaggaggggacgggcaucgcggccgacaaggagagcacccagaaggccaucgaccagaucaccuccaaggugaacaacaucguggacaagaugaacaccaacuucgagagcguccagcacgaguucuccgagaucgaggagcgcaucaaccagcugagcaagcacguggacgacuccguggucgacaucuggagcuacaacgcccagcuccuggugcugcucgagaacgagaagacgcuggaccugcacgacuccaacgugcggaaccuccacgagaagguccgccggaugcugaaggacaacgccaaggacgagggcaacgggugcuucaccuucuaccacaagugcgacaacgagugcaucgagcgcgugcggaacggcaccuacgaccacaaggaguucgaggaggagagcaagaucaaccgccaggagaucgagggggugaagcuggacuccagcggcaacgucuacaagauccucagcaucuacuccugcaucgcgagcucccuggugcuggccgcccucaucaugggcuucauccugugggccugcagcaacggguccugccggugcaccaucugcaucuga

SEQ ID NO: 71342 - RNA, 1698 nt, Artificial Sequence
  derived and/or modified sequence opt1 from hemagglutinin__InfluenzaA__AGQ81202
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacaccgucuggcugauccaccaguccgggaccuacccggugaucaagcgcaccuucaacaacacgaagggccgggacgugcucgucguguggggcgugcaccaccccgccacccugaaggagcaccaggaccuguacaagaaggacagcuccuacgucgcgguggggagcgagaccuacaaccgccgguucauccccgagaucagcacccgccccaaggugaacggccaggccgggcggaugacguucuacuggaccaucgucaagccgggcgaguccaucaccuucgagagcaacggggccuuccucgcgccccgcuacgccuucgagaucguguccgugggcaacgggaagcuguuccggagcgagcugaacaucgaguccugcagcaccaagugccagacggagaucggcggcaucaacaccaacaaguccuuccacagcguccaccgcaacaccaucggggacugccccaaguacgugaacgugaagucccucaagcuggccaccggccugcggaacguccccgccaucgccagccgcgggcuguucggcgccaucgccggguucaucgagggcggcuggccggggcugaucaacggcugguacggguuccagcaccggaacgaggagggcacggggaucgcggccgacaaggaguccacccagaaggccaucgaccagaucaccagcaaggugaacaacaucgucgaccgcaugaacaccaacuucgaguccgugcagcacgagagcuccgagaucgaggagcggaucaaccagcugagcaagcacguggacgacuccauggucgacaucuggagcuacaacgcccagcuccuggugcugcucgagaacgagaagacgcuggaccugcacgacuccaacgugcgcaaccuccacgagaagguccggcgcaugcugaaggacaacgccaaggacgagggcaacggcugcuucaccuucuaccacaagugcgacaacaagugcaucgagcgggugcgcaacgggaccuacgaccacaaggaguucgaggaggagagcaagaucaaccggcaggagaucgagggcgugaagcuggacagcuccgggaacgucuacaagauccucagcaucuacuccugcaucgcgagcucccuggugcuggccgcccucaucaugggcuucauccugugggccugcagcaacggcuccugccgcugcaccaucugcaucuga

SEQ ID NO: 71343 - RNA, 1698 nt, Artificial Sequence
  derived and/or modified sequence opt1 from hemagglutinin__InfluenzaA__AGQ81203
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucaacaaguucgaggccuucaccuccaacggguggggcgccgugaacagcggggcgggcgugacggccgccugcaaguucggcuccagcaacuccuucuuccggaacauggucuggcugauccaccagagcgggaccuacccggugaucaagcgcaccuucaacaacaccaagggccgggacgugcucgucgugugggggauccaccaccccgccacgcugaaggagcaccaggaccuguacaagaaggacuccagcuacguggcggucggcuccgagaccuacaaccgccgguucauccccgagaucagcacccgccccaaggugaacggccaggccgggcggaugaccuucuacuggacgaucgugaagccgggcgagagcaucaccuucgaguccaacggggccuuccucgcgccccgcuacgccuucgagaucgucagcgugggcaacgggaagcuguuccgguccgagcugaacaucgagagcugcuccaccaagugccagaccgagaucggcggcaucaacacgaacaagagcuuccacuccgugcaccgcaacaccaucggggacugccccaaguacgucaacgucaagagccucaagcuggccaccggccugcggaacgugcccgccaucgccucccgcgggcuguucggcgccaucgccggguucaucgagggcggcuggccggggcugaucaacggcugguacggguuccagcaccggaacgaggagggcaccgggaucgcggccgacaaggagagcacgcagaaggccaucgaccagaucaccuccaaggugaacaacaucguggaccgcaugaacaccaacuucgagagcguccagcacgaguucuccgagaucgaggagcggaucaaccagcugagcaagcacguggacgacuccguggucgacaucuggagcuacaacgcccagcuccuggugcugcucgagaacgagaagacccuggaccugcacgacuccaacgugcgcaaccuccacgagaagguccggcgcaugcugaaggacaacgccaaggacgagggcaacggcugcuucacguucuaccacaagugcgacaacgagugcaucgagcgggugcgcaacgggaccuacgaccacaaggaguucgaggaggagagcaagaucaaccggcaggagaucgagggcgugaagcuggacuccagcgggaacgucuacaagauccucagcaucuacuccugcaucgcgagcucccuggugcuggccgcccucaucaugggcuucauccugugggccugcagcaacggcuccugccgcugcaccaucugcaucuga

SEQ ID NO: 71344 - RNA, 1698 nt, Artificial Sequence
  derived and/or modified sequence opt1 from hemagglutinin__InfluenzaA__AGQ81204
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucaacaaguucgaggccuucaccuccaacggguggggcgccgugaacagcggggcgggcgugacggccgccugcaaguucggcuccagcaacuccuucuuccggaacauggucuggcugauccaccagagcgggaccuacccggugaucaagcgcaccuucaacaacaccaagggccgggacgugcucgucgugugggggauccaccaccccgccacgcugaaggagcaccaggaccuguacaagaaggacuccagcuacguggcggucggcuccgagaccuacaaccgccgguucauccccgagaucagcacccgccccaaggugaacggccaggccgggcggaugaccuucuacuggacgaucgugaagccgggcgagagcaucaccuucgaguccaacggggccuuccucgcgccccgcuacgccuucgagaucgucagcgugggcaacgggaagcuguuccgguccgagcugaacaucgagagcugcuccaccaagugccagaccgagaucggcggcaucaacacgaacaagagcuuccacuccgugcaccgcaacaccaucggggacugccccaaguacgucaacgucaagagccucaagcuggccaccggccugcggaacgugcccgccaucgccucccgcgggcuguucggcgccaucgccggguucaucgagggcggcuggccggggcugaucaacggcugguacggguuccagcaccggaacgaggagggcaccgggaucgcggccgacaaggagagcacgcagaaggccaucgaccagaucaccuccaaggugaacaacaucguggaccgcaugaacaccaacuucggcagcguccagcacgaguucuccgagaucgaggagcggaucaaccagcugagcaagcacguggacgacuccguggucgacaucuggagcuacaacgcccagcuccuggugcugcucgagaacgagaagacccuggaccugcacgacuccaacgugcgcaaccuccacgagaagguccggcgcaugcugaaggacaacgccaaggacgagggcaacgggugcuucacguucuaccacaagugcgacaacgagugcaucgagcgggugcgcaacggcaccuacgaccacaaggaguucgaggaggagagcaagaucaaccggcaggagaucgagggggugaagcuggacuccagcggcaacgucuacaagauccucagcaucuacuccugcaucgcgagcucccuggugcuggccgcccucaucaugggcuucauccugugggccugcagcaacggguccugccgcugcaccaucugcaucuga

SEQ ID NO: 71345 - RNA, 1698 nt, Artificial Sequence
  derived and/or modified sequence opt1 from hemagglutinin__InfluenzaA__AGQ81205
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucaacaaguucgaggccuucaccuccaacggguggggcgccgugaacagcggggcgggcgugacggcgaccugcaaguucggcuccagcaacuccuucuuccggaacauggucuggcugauccaccagagcgggaccuacccggugaucaagcgcaccuucaacaacacgaagggccgggacgugcucgucgugugggggauccaccaccccgccacccugaaggagcaccaggaccuguacaagaaggacuccagcuacguggccgucggcuccgagaccuacaaccgccgguucauccccgagaucagcacccgccccaaggugaacggccaggccgggcggaugacguucuacuggaccaucgugaagccgggcgagagcaucaccuucgaguccaacggggccuuccucgcgccccgcuacgccuucgagaucgucagcgugggcaacgggaagcuguuccgguccgagcugaacaucgagagcugcuccaccaagugccagacggagaucggcggcaucaacaccaacaagagcuuccacuccgugcaccgcaacaccaucggggacugccccaaguacgucaacgucaagagccucaagcuggccaccggccugcggaacgugcccgccaucgccucccgcgggcuguucggcgccaucgccggguucaucgagggcggcuggccggggcugaucaacggcugguacggguuccagcaccggaacgaggagggcacggggaucgccgcggacaaggagagcacccagaaggccaucgaccagaucaccuccaaggugaacaacaucguggaccgcaugaacaccaacuucgagagcguccaguacgaguucuccgagaucgaggagcggaucaaccagcugagcaagcacguggacgacuccguggucgacaucuggagcuacaacgcccagcuccuggugcugcucgagaacgagaagacgcuggaccugcacgacuccaacgugcgcaaccuccacgagaagguccggcgcaugcugaaggacaacgccaaggacgagggcaacggcugcuucaccuucuaccacaagugcgacaacgagugcaucgagcgggugcgcaacgggaccuacgaccacaaggaguucgaggaggagagcaagaucaaccggcaggagaucgagggcgugaagcuggacuccagcgggaacgucuacaagauccucagcaucuacuccugcaucgccagcucccuggugcuggcggcccucaucaugggcuucauccugugggccugcagcaacggcuccugccgcugcaccaucugcaucuga

SEQ ID NO: 71346 - RNA, 1698 nt, Artificial Sequence
  derived and/or modified sequence opt1 from hemagglutinin__InfluenzaA__AGQ81206
augaagaagacccuccucuucgccgccaucuuccuguacgcgaaggccgacgagaucugcaucggcuaccugagcaacaacuccaccgacaagguggacacgaucaucgagaacaacgucaccgugaccagcuccguggagcucgucgagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgcagcaaguucuccggcgugcucgaguucagcaaguucgaggccuucaccuccaacggguggggcgcggucaacagcggggccggcgugacggccgccugcaaguucggcuccagcaacuccuucuuccggaacaugguguggcugauccaccagagcgggaccuacccggucaucaagcgcaccuucaacaacaccaagggccgggacgugcugguggucugggggauccaccaccccgcgacgcucaaggagcaccaggaccuguacaagaaggacuccagcuacguggccgugggcagcgagaccuacaaccgccgguucauccccgagaucuccacccgccccaaggucaacggccaggccgggcggaugaccuucuacuggacgaucgugaagccggaggagagcaucaccuucgaguccaacggcgccuuccuggcgccccgcuacgccuucgagaucgugagcgucgggaacggcaagcuguuccgguccgagcugaacaucgagagcugcuccaccaagugccagaccgagaucgggggcaucaacacgaacaagagcuuccacuccgugcaccgcaacaccaucggcgacugccccaaguacgugaacgucaagagccugaagcucgccaccgggcugcggaacgugcccgccaucgccucccgcggccuguucggggccaucgcgggcuucaucgagggcggguggccgggccucaucaacgggugguacggcuuccagcaccggaacgaggaggggaccggcaucgccgccgacaaggagagcacgcagaaggccaucgaccagaucaccuccaaggugaacaacaucgucgaccgcaugaacaccaacuucgagagcgugcagcacgaguucuccgagaucgaggagcggaucaaccagcugagcaagcacgucgacgacuccgugguggacaucuggagcuacaacgcccagcugcucguccugcuggagaacgagaagacccucgaccugcacgacuccaacgugcgcaaccugcacgagaaggugcggcgcaugcucaaggacaacgcgaaggacgaggggaacggcugcuucacguucuaccacaagugcgacaacgagugcaucgagcggguccgcaacggcaccuacgaccacaaggaguucgaggaggagagcaagaucaaccggcaggagaucgagggggugaagcuggacagcuccggcaacguguacaagauccugagcaucuacuccugcaucgccagcucccucauccuggccgcccugaucaugggguucauccucugggccugcagcaacggcuccugccgcugcaccaucugcaucuga

SEQ ID NO: 71347 - RNA, 1698 nt, Artificial Sequence
  derived and/or modified sequence opt1 from hemagglutinin__InfluenzaA__AGQ81209
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcauccuggaguucuccaaguucgaggccuucaccagcaacggguggggcgccgucaacuccggggcgggcgugacggccgccugcaaguucggcagcuccaacagcuucuuccggaacaugguguggcugauccaccaguccgggaccuacccggucaucaagcgcaccuucaacaacaccaagggccgggacgugcucaucgugugggggauccaccaccccgccacgcugaaggagcaccaggaccuguacaagaaggacagcuccuacgucgcggugggcagcgagaccuacaaccgccgguucauccccgagaucagcacccgccccaaggugaacggccaggccgggcggaugaccuucuacuggacgaucgucaagccgggcgaguccaucaccuucgagagcaacggggccuuccucgcgccccgcuacgccuucgagaucguguccgugggcaacgggaagcuguuccggagcgagcugaacaucgaguccugcagcaccaagugccagaccgagaucggcggcaucaacacgaacaaguccuuccacagcguccaccgcaacaccaucggggacugccccaaguacgugaacgugaagucccucaagcuggccaccggccugcggaacguccccgccaucgccagccgcgggcuguucggcgccaucgccggguucaucgagggcggcuggccggggcugaucaacggcugguacggguuccagcaccggaacgaggagggcaccgggaucgcggccgacaaggaguccacgcagaaggccaucgaccagaucaccagcaaggugaacaacaucguggaccgcaugaacaccaacuucgaguccguccagcacgaguucagcgagaucgaggagcggaucaaccagcuguccaagcacguggacgacagcgucguggacaucugguccuacaacgcccagcuccuggugcugcucgagaacgagaagacccuggaccugcacgacagcaacguccgcaaccuccacgagaaggugcggcgcaugcugaaggacaacgccaaggacgagggcaacggcugcuucacguucuaccacaagugcgacaacgagugcaucgagcgggugcgcaacgggaccuacgaccacaaggaguucgaggaggaguccaagaucaaccggcaggagaucgagggcgucaagcuggacagcagcgggaacguguaccgcauccucuccaucuacagcugcaucgcguccagccuggugcuggccgcccucaucaugggcuucauccugugggccugcuccaacggcagcugccgcugcaccaucugcaucuga

SEQ ID NO: 71348 - RNA, 1698 nt, Artificial Sequence
  derived and/or modified sequence opt1 from hemagglutinin__InfluenzaA__AGQ81211
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaucaagcgcaccuucaacaacaccaagggccgggacgugcucaucgucugggggauccaccaccccgccacgcugaaggagcaccaggaccuguacaagaaggacagcuccuacguggcggugggcagcgagaccuacaaccgccgguucauccccgagaucagcacccgccccaaggucaacggccaggccgggcggaugaccuucuacuggacgaucgugaagccgggcgaguccaucaccuucgagagcaacggggccuuccucgcgccccgcuacgccuucgagaucguguccgucggcaacgggaagcuguuccggagcgagcugaacaucgaguccugcagcaccaagugccagaccgagaucggcggcaucaacacgaacaaguccuuccacagcgugcaccgcaacaccaucggggacugccccaaguacgugaacgucaagucccucaagcuggccaccggccugcggaacgugcccgccaucgccagccgcgggcuguucggcgccaucgccggguucaucgagggcggcuggccggggcugaucaacggcugguacggguuccagcaccggaacgaggagggcaccgggaucgcggccgacaaggaguccacgcagaaggccaucgaccagaucaccagcaaggugaacaacaucgucgaccgcaugaacaccaacuucgaguccgugcagcacgaguucagcgagaucgaggagcggaucaaccagcuguccaagcacgucgacgacagcgugguggacaucugguccuacaacgcccagcuccugguccugcucgagaacgagaagacccuggaccugcacgacuucaacgugcgcaaccuccacgagaaggugcggcgcaugcugaaggacaacgccaaggacgagggcaacggcugcuucacguucuaccacaagugcgacaacgagugcaucgagcggguccgcaacgggaccuacgaccacaaggaguucgaggaggagagcaagaucaaccggcaggagaucgagggcgugaagcuggacuccagcgggaacguguaccgcauccucagcaucuacuccugcaucgcgagcucccugguccuggccgcccucaucaugggcuucauccugugggccugcagcaacggcuccugccgcugcaccaucugcaucuga

SEQ ID NO: 71349 - RNA, 1698 nt, Artificial Sequence
  derived and/or modified sequence opt1 from hemagglutinin__InfluenzaA__AGQ81213
augaagaagacccuccucuucgccgccaucuuccuguacgugcgcgcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacggccucaucggcaagaccagcugguccuacaucguggagaagcccaaccccgccaacgggaucugcuaccccggcacccuggagaacgaggaggagcugcggcucaaguucagccgcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaucaagcgcaccuucaacaacaccaagggccgggacgugcucgucgugugggggauccaccaccccgccacgcugaaggagcaccaggaccuguacaagaaggacagcuccuacguggcggucggcagcgagaccuacaaccgccgguucauccccgagaucagcacccgccccaccgugaacggccaggccgggcggaugacguucuacuggaccaucgugaagccgggcgaguccaucaccuucgagagcaacggggccuuccucgcgccccgcuacgccuucgagaucgucuccgugggcaacgggaagcuguuccggagcgagcugaacaucgaguccugcagcaccaagugccagacggagaucggcggcaucaacaccaacaaguccuuccacagcgugcaccgcaacaccaucggggacugccccaaguacgucaacgugaagucccucaagcuggccaccggccugcggaacgugcccgccaucgccagccgcgggcuguucggcgccaucgccggguucaucgagggcggcuggccggggcugaucaacggcugguacggguuccagcaccggaacgaggagggcacggggaucgcggccgacaaggaguccacccagaaggccaucgaccagaucaccagcaaggucaacaacaucguggaccgcaugaacaccaacuucgaguccguccagcacgaguucagcgagaucgaggagcggaucaaccagcuguccaagcacguggacgacagcguggucgacaucugguccuacaacgcccagcuccuggugcugcucgagaacgagaagacgcuggaccugcacgacagcaacgugcgcaaccuccacgagaagguccggcgcaugcugaaggacaacgccaaggacgagggcaacggcugcuucaccuucuaccacaagugcgacaacgagugcaucgagcgggugcgcaacgggaccuacgaccacaaggaguucgaggaggaguccaagaucaaccgccaggagaucgagggcgugaagcuggacagcagcgggaacgucuacaagauccucuccaucuacagcugcaucgcguccagccuggugcuggccgcccucaucaugggcuucauccugugggccugcuccaacggcagcugccggugcaccaucugcaucuga

SEQ ID NO: 71350 - RNA, 1698 nt, Artificial Sequence
  derived and/or modified sequence opt1 from hemagglutinin__InfluenzaA__AGQ81214
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaucaagcgcaccuucaacaacaccaagggccgggacgugcucaucgucugggggauccaccaccccgccacgcugaaggagcaccaggaccuguacaagaaggacagcuccuacguggcggugggcagcgagaccuacaaccgccgguucauccccgagaucagcacccgccccaaggucaacggccaggccgggcggaugaccuucuacuggacgaucgugaagccgggcgaguccaucaccuucgagagcaacggggccuuccucgcgccccgcuacgccuucgagaucguguccgucggcaacgggaagcuguuccggagcgagcugaacaucgaguccugcagcaccaagugccagaccgagaucggcggcaucaacacgaacaaguccuuccacagcgugcaccgcaacaccaucggggacugccccaaguacgugaacgucaagucccucaagcuggccaccggccugcggaacgugcccgccaucaccagccgcgggcuguucggcgccaucgccggguucaucgagggcggcuggccggggcugaucaacggcugguacggguuccagcaccggaacgaggagggcacggggaucgccgcggacaaggaguccacccagaaggccaucgaccagaucaccagcaaggugaacaacaucgucgaccgcaugaacaccaacuucgaguccgugcagcacgaguucagcgagaucgagggccggaucaaccagcuguccaagcacgucgacgacagcgugguggacaucugguccuacaacgcccagcuccugguccugcucgagaacgagaagacgcuggaccugcacgacagcaacgugcgcaaccuccacgagaaggugcggcgcaugcugaaggacaacgccaaggacgagggcaacgggugcuucaccuucuaccacaagugcgacaacgagugcaucgagcggguccgcaacggcaccuacgaccacaaggaguucgaggaggaguccaagaucaaccggcaggagaucgagggggugaagcuggacagcagcggcaacguguacaagauccucuccaucuacagcugcaucgccuccagccugguccuggcggcccucaucaugggcuucauccugugggccugcuccaacgggagcugccgcugcaccaucugcaucuga

SEQ ID NO: 71351 - RNA, 1698 nt, Artificial Sequence
  derived and/or modified sequence opt1 from hemagglutinin__InfluenzaA__AGQ81215
augaagaagacccuccuguucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacggccucaucggcaagaccagcugguccuacaucguggagaagcccaaccccgccaacgggaucugcuaccccggcacccuggagaacgaggaggagcugcgccucaaguucagcgggauccuggaguucuccaaguucgaggccuucaccagcaacggcuggggcgccgucaacuccggggcgggcgugacggccgccugcaaguucgggagcuccaacagcuucuuccggcacaugguguggcugauccaccaguccggcaccuacccggucaucaagcgcaccuucaacaacaccaaggggcgggacgugcucguggucuggggcauccaccaccccgccacgcugaaggagcagcaggaccuguacaagaaggacagcuccuacguggcggugggcagcgagaccuacaaccgccgguucauccccgagaucagcacccgccccaaggucaacgggcaggccggccggaugaccuucuacuggacgaucgugaagccgggggaguccaucaccuucgagagcaacggcgccuuccucgcgccccgcuacgccuucgagaucguguccgucgggaacggcaagcuguuccggagcgagcugaacaucgaguccugcagcaccaagugccagaccgagaucggcgggaucaacacgaacaaguccuuccacagcgugcaccgcaacaccaucggcgacugccccaaguacgugaacgucaagucccucaagcuggccaccgggcugcggaacgugcccgccaucgccagccgcggccucuucggggccaucgccggcuucaucgagggcggguggccgggccugaucaacgggugguacggcuuccagcaccggaacgaggaggggaccggcaucgcggccgacaaggaguccacgcagaaggccaucgaccagaucaccagcaaggugaacaacaucgucgaccgcaugaacaccaacuucgaguccgugcagcacgaguucagcgagaucgaggagcggaucaaccagcuguccaagcacgucgacgacagcgugguggacaucugguccuacaacgcccagcuccugguccugcucgagaacgagaagacccuggaccugcacgacagcaacgugcgcaaccuccacgagaaggugcggcgcaugcugaaggacaacgccaaggacgagggcaacgggugcuucacguucuaccacaagugcgacaacgagugcaucgagcggguccgcaacggcaccuacgaccacaaggaguucgaggaggaguccaagaucaaccggcaggagaucgagggggugaagcuggacagcagcggcaacguguacaagauccucuccaucuacagcugcaucgcguccagccugguccuggccgcccucaucaugggcuucauccugugggccugcuccaacgggagcugccgcugcaccaucugcaucuga

SEQ ID NO: 71352 - RNA, 1698 nt, Artificial Sequence
  derived and/or modified sequence opt1 from hemagglutinin__InfluenzaA__AGQ81216
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaccaagcgcaccuucaacaacacgaagggccgggacgugcucgucgugugggggauccaccaccccgccacccugaaggagcaccaggaccuguacaagaaggacagcuccuacguggcggucggcagcgagaccuacaaccgccgguucacccccgagaucagcacgcgccccaaggugaacggccaggccgggcggaugaccuucuacuggaccaucgugaagccgggcgaguccaucaccuucgagagcaacggggccuuccucgcgccccgcuacgccuucgagaucgucuccgugggcaacgggaagcuguuccggagcgagcugaacaucgaguccugcagcacgaagugccagaccgagaucggcggcaucaacaccaacaaguccuuccacagcgugcaccgcaacaccaucggggacugccccaaguacgucaacgugaagucccucaagcuggccacgggccugcggaacgugcccgccaucgccagcaaggggcuguucggcgccaucgccggguucaucgagggcggcuggccggggcugaucaacggcugguacggguuccagcaccgcaacgaggagggcaccgggaucgcggccgacaaggaguccacccagaaggccaucgaccagaucaccagcaaggucaacaacaucguggaccggaugaacacgaacuucgaguccguccgccacgaguucagcgagaucgaggagcggaucaaccagcuguccaagcacguggacgacagcguggucgacaucugguccuacaacgcccagcuccuggugcugcucgagaacgagaagacccuggaccugcacgacagcaacgugcgcaaccuccacgagcggguccgccggaugcugaaggacaacgccaaggacgagggcaacggcugcuucaccuucuaccacaagugcgacaacgagugcaucgagcgcgugcggaacgggaccuacgaccacaaggaguucgaggaggaguccaagaucaaccgccaggagaucgagggcgugaagcuggacagcagcgggaacgucuacaagauccucuccaucuacagcugcaucgcguccagccuggugcuggccgcccucaucaugggcuucauccugugggccugcggcaacggguccugccgcugcacgaucugcaucuga

SEQ ID NO: 71353 - RNA, 1698 nt, Artificial Sequence
  derived and/or modified sequence opt1 from hemagglutinin__InfluenzaA__AGQ81217
augaagaagacccuccuguucgccgccaucuuccuguacgcgaaggccgacgagaucugcaucggcuaccugagcaacaacuccaccgacaagguggacacgaucaucgagaacaacgucaccgugaccagcuccguggagcucgucgagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcgugcuggaguucucccgguucgaggccuucaccagcaacggguggggcgcggucaacuccggggccggcgugacggccgccugcaaguucggcagcuccaacagcuucuuccgcaacaugguguggcugauccaccaguccgggaccuacccggucaucaagcggaccuucaacaacaccaagggccgcgacgugcucguggucugggggauccaccaccccgcgacgcugaaggagcaccaggaccuguacaagaaggacagcuccuacguggccgugggcagcgagaccuacaaccggcgcuucauccccgagaucagcacccggcccaaggucaacggccaggccgggcgcaugaccuucuacuggacgaucgugaagccggaggaguccaucaccuucgagagcaacggcgccuuccucgcgccccgguacgccuucgagaucguguccgucgggaacggcaagcuguuccgcagcgagcugaacaucgaguccugcagcaccaagugccagaccgagaucgggggcaucaacacgaacaaguccuuccacagcgugcaccggaacaccaucggcgacugccccaaguacgugaacgucaagucccucaagcuggccaccgggcugcgcaacgugcccgccaucgccagccggggccucuucggggccaucgcgggcuucaucgagggcggguggccgggccugaucaacgggugguacggcuuccagcaccgcaacgaggaggggaccggcaucgccgccgacaaggaguccacgcagaaggccaucgaccagaucaccagcaaggugaacaacaucgucgaccggaugaacaccaacuucgaguccgugcagcacgaguucagcgagaucgaggagcgcaucaaccagcuguccaagcacgucgacgacagcgugguggacaucugguccuacaacgcccagcuccugguccugcucgagaacgagaagacccuggaccugcacgacagcaacgugcggaaccuccacgagaaggugcgccggaugcugaaggacaacgcgaaggacgaggggaacggcugcuucacguucuaccacaagugcgacaacgagugcaucgagcgcguccggaacggcaccuacgaccacaaggaguucgaggaggaguccaagaucaaccgccaggagaucgagggggugaagcuggacagcagcggcaacguguacaagauccucuccaucuacagcugcaucgccuccagccugauccuggccgcccucaucaugggguucauccugugggccugcuccaacggcagcugccgcugcaccaucugcaucuga

SEQ ID NO: 71354 - RNA, 1704 nt, Artificial Sequence
  derived and/or modified sequence opt1 from hemagglutinin__InfluenzaA__AGQ88499
auggagaagaucgugcugcuguucgccaccaucagccuggucaaguccgaccacaucugcaucggcuaccacgccaacaacagcaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgaccucugcuaccccgggaacuucaacgacuacgaggagcugaagcaccuccucucccgcaucaaccacuucgagaagauccagaucaucccgaaggacagcuggacggaccacgaggccucccugggcgugagcgcggccugccccuaccagggcaacuccagcuucuuccggaacgucguguggcugaucaagaaggacaacgccuaccccaccaucaagaagggguacaacaacaccaaccaggaggaccuccuggugcuguggggcauccaccaccccaacaacgaggccgagcagacccgccucuaccagaacccgacgaccuacaucuccaucgggaccagcacccugaaccagcggcugguccccaagaucgcgacgcgcuccaagaucaacggccagagcgggcggaucgacuucuucuggaccauccucaagcccaacgacgccauccacuucgaguccaacggcaacuucaucgcccccgaguacgccuacaagaucgugaagaagggcgacagcaccaucaugaaguccgagguggaguacgggaacugcaacacccgcugccagacgccgaucggcgccaucaacagcuccaugcccuuccacaacauccacccccugaccaucggggagugccccaaguacgucaagagcaacaagcuggugcucgcgaccggccugcggaacagcccgcagcgcgagcggcgccggaagcgcggccuguucggggccaucgccggcuucaucgagggcggguggcaggggaugguggacggcugguacggcuaccaccacuccaacgagcaggggagcggcuacgccgccgacaaggaguccacccagaaggcgaucgacggggucacgaacaaggugaacagcaucaucgacaagaugaacacccaguucgaggccgugggccgggaguucaacaaccucgagcgccggaucgagaaccugaacaagaagauggaggacggguuccuggacgucuggaccuacaacgccgagcuccuggugcugauggagaacgagcgcacccucgacuaccacgacuccaacgugcggaaccuguacgacaagguccgccugcagcucaaggacaacgccaaggagcugggcaacggcugcuucgaguucuaccacaagugcaacaacgagugcauggagagcgugcggaacgggacguacgacuacccccaguacuccgaggaggcccgccugaagcgggaggagaucagcggcgucaagcucgaguccaucgggaucuaccagauccugagcaucuacuccaccguggcgagcucccuggugcucgccaucaugauggccggccugagccuguggaugugcuccaacgggagccuccagugccgcaucugcaucuga

SEQ ID NO: 71355 - RNA, 1683 nt, Artificial Sequence; identical to SEQ ID NO: 71245
  derived and/or modified sequence opt1 from hemagglutinin__InfluenzaA__AGR33888

SEQ ID NO: 71356 - RNA, 1683 nt, Artificial Sequence; identical to SEQ ID NO: 71245
  derived and/or modified sequence opt1 from hemagglutinin__InfluenzaA__AGR33889

SEQ ID NO: 71357 - RNA, 1683 nt, Artificial Sequence
  derived and/or modified sequence opt1 from hemagglutinin__InfluenzaA__AGR33890
augaacacccagauccugguguucgcccucaucgccaucacccccacgaacagcgacaagaucugccugggccaccacgcggucuccaacgggaccaaggugaacacccugaccgagcgcggcguggaggucgugaacgccacggagaccguggagcggaccagcaucccgcgcaucugcuccaaggggaagcggaccgucgaccucggccagugcgggcugcugggcacgaucaccggcccgccccagugcgaccaguuccucgaguucagcgccgaccugaucaucgagcgccgggagggguccgacgugugcuaccccggcaaguucgugaacgaggaggcccugcgccagauccuccgggagagcgggggcaucgacaaggaggccaugggguucaccuacuccggcauccgcaccaacggcgcgacgagcgccugccggcgcuccgggagcuccuucuacgccgagaugaaguggcugcugagcaacaccgacaacgccgcguucccgcccaugaccaaguccuacaagaacacccggaaggcccccgcccucaucaucuggggcauccaccacagcgucuccacggccgagcagaccaagcuguacgggagcggcaacaagcuggugaccgugcgcuccagcaacuaccagcaguccuucguccccagccccggcgccgggccccaggugaacggccagagcgggcggaucgacuuccacuggcucaugcugaaccccaacgacaccgugacguucuccuucaacggcgcguucaucgcccccgaccgcgccagcuuccugcgggggaaguccaugggcauccagagcggcguccagguggacgccaacugcgagggggacugcuaccacuccggcgggaccaucaucagcaaccucccguuccagaacaucgacucccgcguggucggcaagugcccccgguacgugaagcagaagucccugcugcucgccaccgggaugaagaacgugcccgagauccccaagggccgcggccuguucggggcgaucgccggcuucaucgagaacgggugggagggccugaucgacgggugguacggcuuccggcaccagaacgcccagggcgaggggaccgccgccgacuacaagagcacgcagagcgcgaucaaccagaugaccggcaagcucaaccgccugaucgagaagaccaaccagcaguucgagcugaucgacaacgaguucaccgaggucgagaagcagaucgggaacgugaucaacuggacgcgggacuccaucaccgagguguggagcuacaacgccgagcuccuggucgccauggagaaccagcacaccaucgaccuggccgacuccgagaugaacaagcucuacgagcgcgugaagcgccagcugcgggagaacgccgaggaggacggcaccggcugcuucgagaucuuccacaagugcgacgacgacugcauggcgagcauccgcaacaacacguacgaccacuccaaguaccgggaggaggccaugcagaaccgcauccagaucgacccggucaagcugagcuccggguacaaggacgugauccucugguucagcuucggcgccuccugcuucauccugcuggccaucgcgauggggcucguguucaucugcgucaagaacggcaacaugcggugcaccaucugcaucuga

SEQ ID NO: 71358 - RNA, 1683 nt, Artificial Sequence
  derived and/or modified sequence opt1 from hemagglutinin__InfluenzaA__AGR33892
augaacacccagauccugguguucgcccucaucgccaucauccccaccaacgcggacaagaucugccugggccaccacgccgucagcaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuccucgaguucuccgccgaccugaucaucgagcgccgggaggggagcgacgugugcuaccccggcaaguucgugaacgaggaggcccugcgccagauccuccgggaguccgggggcaucaacaaggaggcgaugggguucaccuacagcggcauccgcaccaacggcgccaccuccgccugccggcgcagcggguccagcuucuacgccgagaugaaguggcugcuguccaacacggacaacgcggccuucccgcccaugaccaagagcuacaagaacacccggaaggcccccgcccucaucaucuggggcauccaccacuccgggagcaccgccgagcagacgaagcuguacggcuccggcaacaagauggucaccgugcgcagcuccaacuaccagcagagcuucgugcccucccccggggcgggcccccaggucaacgggcagagcggccggaucgacuuccacuggcugaugcucaaccccaacgacaccgugaccuucagcuucaacggggccuucaucgcccccgaccgcgccuccuuccugcggggcaagagcaugggcauccaguccggggugcaggucgacgccaacugcgagggcgacugcuaccacagcgggggcacgaucaucuccaaccugccguuccagaacaucgacagccgcgugguggggaagugcccccgguacgucaagcagaagucccuccugcuggcgaccggcaugaagaacgugcccgagauccccaagggccgcggccucuucggggccaucgccggguucaucgagaacggcugggaggggcugaucgacggcugguacggcuuccggcaccagaacgcccagggggagggcaccgccgcggacuacaagagcacccaguccgccaucaaccagaugacggggaagcugaaccgccucaucgagaagaccaaccagcaguucgagcugaucgacaacgaguucaccgagguggagaagcagaucggcaacgucaucaacuggacccgggacagcaucacggaggugugguccuacaacgccgagcugcucguggccauggagaaccagcacaccaucgaccuggccgacagcgagaugaacaagcuguacgagcgcgucaagcgccagcuccgggagaacgcggaggaggacggcaccgggugcuucgagaucuuccacaagugcgacgacgacugcauggccuccauccgcaacaacaccuacgaccacagcaaguaccgggaggaggccaugcagaaccgcauccagaucgacccggugaagcuguccagcggcuacaaggacgucauccugugguucuccuucggggccagcugcuucauccuccuggcgaucgccaugggccugguguucaucugcguggagaacgggaacaugcggugcacgaucugcaucuga

SEQ ID NO: 71359 - RNA, 1683 nt, Artificial Sequence; identical to SEQ ID NO: 71237
  derived and/or modified sequence opt1 from hemagglutinin__InfluenzaA__AGR33895

SEQ ID NO: 71360 - RNA, 1683 nt, Artificial Sequence; identical to SEQ ID NO: 71316
  derived and/or modified sequence opt1 from hemagglutinin__InfluenzaA__AGR33897

SEQ ID NO: 71361 - RNA, 1683 nt, Artificial Sequence
  derived and/or modified sequence opt1 from hemagglutinin__InfluenzaA__AGR33899
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacaacgggaccuccaaggccugcagcggcuccuucuaccggagcaugcgcuggcugacccagaagaacuccaacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagaaggggagcugcaccguccagugccagaccgagaagggcgggcugaacacgacccuccccuuccagaacguguccaaguacgccuucggcaacugcagcaaguacaucgggaucaagucccugaagcuggcggugggccuccgcaacguccccagccgguccagccgcggccuguucggggccaucgccggcuucaucgagggcgggugguccgggcugguggccggcugguacggcuuccagcacagcaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggagcaacgccgucgaggacggcaaggggugcuucgagcuguaccacaagugcgacgaccagugcauggagaccauccgcaacggcaccuacaaccgguccaaguaccaggaggagagcaagcucgagcgccagaagaucgagggcgugaagcuggaguccgaggggacguacaagauccugaccaucuacagcaccgucgccuccagccucgugaucgccaugggcuucgccgcguuccuguucugggccaugagcaacggguccugccgcugcaacaucugcaucuga

SEQ ID NO: 71362 - RNA, 1683 nt, Artificial Sequence
  derived and/or modified sequence opt1 from hemagglutinin__InfluenzaA__AGR33900
auggagaccgugagccugaucaccauccuccuggucgccacgguguccaacgccgacaagaucugcaucggcuaccagagcaccaacuccaccgagaccguggacacgcugaccgagaacaacguccccgugacccacgcgaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcagccuguucuccagcgcccgguccuaccagcgcauccagaucuucccggacaccaucuggaacgugagcuacaacgggaccuccaaggccugcagcggcuccuucuaccggagcaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagaaggggagcugcaccguccagugccagaccgagaagggcgggcugaacacgacccuccccuuccagaacguguccaaguacgccuucggcaacugcagcaaguacaucgggaucaagucccugaagcuggcggugggccuccgcaacguccccagccgguccagccgcggccuguucggggccaucgccggcuucaucgagggcgggugguccgggcugguggccggcugguacggcuuccagcacagcaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggagcaacgccgucgaggacggcaaggggugcuucgaccuguaccacaagugcgacgaccagugcauggagaccauccgcaacggcaccuacaaccggcgcaaguaccaggaggaguccaagcucgagcgccagaagaucgagggcgugaagcuggagagcgaggggacguacaagauccugaccaucuacuccaccgucgccagcucccucgugaucgccaugggcuucgccgcguuccuguucugggccaugagcaacgggagcugccggugcaacaucugcaucuga

SEQ ID NO: 71363 - RNA, 1683 nt, Artificial Sequence
  derived and/or modified sequence opt1 from hemagglutinin__InfluenzaA__AGR33902
auggagaccgccagccugaucaccauccuccugguggccacggucuccaacgcggacaagaucugcaucggcuaccagagcaccaacuccaccgagaccguggacacgcugaccgagaacaacgugcccgucacccacgccaaggagcuccugcacaccgagcacaacgggaugcugugcgccacgagccucggccagccgcugauccuggacacgugcaccaucgaggggcucaucuacggcaaccccuccugcgaccugcugcucgaggggcgcgaguggagcuacaucguggagcggcccuccgccgugaacggccugugcuaccccggcaacgucgagaaccuggaggagcuccgcagccuguucuccagcgcccgguccuaccagcgcauccagaucuucccggacaccaccuggaacgugagcuacaacgggaucuccaaggcgugcagcggcuccuucuaccggagcaugcgcuggcugacccagaagaacuccaacuaccccauccaggacgcccaguacaccaacaaccaggggaagaacauccucuucauguggggcaucaaccacccgcccaccgacacgacccagcgggaccuguacacccgcaccgacacgaccaccagcguggccaccgaggagaucaaccggaucuucaagccccugaucgggccccgcccccucgucaacggccugaugggccggaucgacuacuacugguccgugcugaagcccgggcagacgcuccgcaucaagagcgacggcaaccugaucgccccgugguacgggcacauccugagcggcgagucccacggccggauccucaagaccgaccugaagcgcgggagcugcaccgugcagugccagaccgagaagggcgggcugaacacgacccuccccuuccagaacgucuccaaguacgcguucggcaacugcagcaaguacaucgggaucaagucccugaagcuggccgugggccuccggaacgugcccagccgcuccagccggggccuguucggggccaucgccggcuucaucgagggcgggugguccgggcuggucgccggcugguacggcuuccagcacagcaacgaccagggggugggcauggcggccgaccgcgacuccacccagaaggccaucgacaagaucaccagcaaggugaacaacaucgucgacaagaugaacaagcaguacgagaucaucgaccacgaguucuccgagguggagacgcggcucaacaugaucaacaacaagaucgacgaccagauccaggacaucugggccuacaacgccgagcugcuggugcuccuggagaaccagaagacccuggacgagcacgacgcgaacgucaacaaccucuacaacaaggugaagcgcgcccuggggagcaacgccguggaggacggcaaggggugcuucgagcuguaccacaagugcgacaaccagugcauggagaccauccggaacggcaccuacaaccgccgcaaguaccaggaggaguccaagcucgagcggcagaagaucgagggcgucaagcuggagagcgaggggacguacaagauccugaccaucuacuccaccguggccagcucccucgucaucgccaugggcuucgcggccuuccuguucugggccaugagcaacgggagcugccgcugcaacaucugcaucuga

SEQ ID NO: 71364 - RNA, 1698 nt, Artificial Sequence; identical to SEQ ID NO: 66521
  derived and/or modified sequence opt1 from hemagglutinin__InfluenzaA__AGR49817

SEQ ID NO: 71365 - RNA, 1698 nt, Artificial Sequence
  derived and/or modified sequence opt1 from hemagglutinin__InfluenzaA__AGR49841
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagccccgcgacaccaucaucuucgaggccaacggcaaccugaucgcgccgcgguacgccuucgcccucucccgcggguucggcagcgggaucaucaacuccaacgcccccaugggcaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggucaagcucgaguccaucggcguguaccagauccuggcgaucuacagcaccguggccagcucccugguccuccuggugagccugggcgccaucuccuucuggaugugcagcaacgggucccuccagugccggaucugcaucuga

SEQ ID NO: 71366 - RNA, 1698 nt, Artificial Sequence; identical to SEQ ID NO: 66521
  derived and/or modified sequence opt1 from hemagglutinin__InfluenzaA__AGR49853

SEQ ID NO: 71367 - RNA, 1698 nt, Artificial Sequence
  derived and/or modified sequence opt1 from hemagglutinin__InfluenzaA__AGR49865
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccaacaucgugaaccagaagacccuguaccggacggagaacgccuacgucuccguggugagcagccacuacucccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucaaccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacguguggacguacaacgccgagcugcugguccuccuggagaacgagcgcacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgggagaagaucgacggggugaagcucgaguccaugggcguguaccagauccuggcgaucuacagcaccgucgccuccagccuggugcuccuggugagccugggcgccaucuccuucuggaugugcagcaacgggucccuccagugccgcaucugcaucuga

SEQ ID NO: 71368 - RNA, 1701 nt, Artificial Sequence; identical to SEQ ID NO: 63664
  derived and/or modified sequence opt1 from hemagglutinin__InfluenzaA__AGR49877

SEQ ID NO: 71369 - RNA, 1701 nt, Artificial Sequence; identical to SEQ ID NO: 63442
  derived and/or modified sequence opt1 from hemagglutinin__InfluenzaA__AGR49888

SEQ ID NO: 71370 - RNA, 1701 nt, Artificial Sequence
  derived and/or modified sequence opt1 from hemagglutinin__InfluenzaA__AGR49900
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaagugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 71371 - RNA, 1701 nt, Artificial Sequence
  derived and/or modified sequence opt1 from hemagglutinin__InfluenzaA__AGR49912
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccaagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 71372 - RNA, 1701 nt, Artificial Sequence
  derived and/or modified sequence opt1 from hemagglutinin__InfluenzaA__AGR49924
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccaagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccgucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 71373 - RNA, 1701 nt, Artificial Sequence
  derived and/or modified sequence opt1 from hemagglutinin__InfluenzaA__AGR49936
augaagaccaucaucgcccugagcuacauccucugccugaucuccgcccagaaguuccccggcaacgacaacagcaccgcgacgcugugccucgggcaccacgccgugccgaacggcaccaucgucaagaccaucaccaacgaccagaucgaggugacgaacgccaccgagcuggugcaguccagcuccaccggggagaucugcgacagcccccaccagauccuggacggcgagaacugcacccucaucgacgcccugcugggggacccccagugcgacggcuuccagaacaagaagugggaccucuucgucgagcgcuccaaggccuacagcaacugcuaccccuacgacgugccgggcuacgcgucccugcggagccugguggccuccagcgggacgcucgaguucaacaacgaguccuucaacuggaccggcgucacccagaacgggaccagcuccgccugcauccgccggagcaacaacuccuucuucagccgccugaacuggcugacgcaccucaaguucaaguaccccgcccugaacgugaccaugcccaacaacgaggaguucgacaagcuguacaucuggggcgugcaccaccccgggaccgacaacgaccagaucuuccucuacgcgcaggccuccggccggaucaccgucagcacgaagcgcagccagcagaccgugaucccgaacaucggcucccggccccgcgugcggaacauccccagccgcaucuccaucuacuggaccaucgucaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcuggcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacaugggcaacgggugcuucaagaucuaccacaagugcgacaacgcgugcaucggcagcauccgcaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 71374 - RNA, 1701 nt, Artificial Sequence; identical to SEQ ID NO: 68702
  derived and/or modified sequence opt1 from hemagglutinin__InfluenzaA__AGR49948

SEQ ID NO: 71375 - RNA, 1701 nt, Artificial Sequence; identical to SEQ ID NO: 63535
  derived and/or modified sequence opt1 from hemagglutinin__InfluenzaA__AGR49960

SEQ ID NO: 71376 - RNA, 1701 nt, Artificial Sequence
  derived and/or modified sequence opt1 from hemagglutinin__InfluenzaA__AGR49972
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgaucguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 71377 - RNA, 1698 nt, Artificial Sequence; identical to SEQ ID NO: 67706
  derived and/or modified sequence opt1 from hemagglutinin__InfluenzaA__AGR49983

SEQ ID NO: 71378 - RNA, 1698 nt, Artificial Sequence; identical to SEQ ID NO: 67706
  derived and/or modified sequence opt1 from hemagglutinin__InfluenzaA__AGR49995

SEQ ID NO: 71379 - RNA, 1701 nt, Artificial Sequence; identical to SEQ ID NO: 63664
  derived and/or modified sequence opt1 from hemagglutinin__InfluenzaA__AGR50007

SEQ ID NO: 71380 - RNA, 1701 nt, Artificial Sequence; identical to SEQ ID NO: 63664
  derived and/or modified sequence opt1 from hemagglutinin__InfluenzaA__AGR50018

SEQ ID NO: 71381 - RNA, 1701 nt, Artificial Sequence; identical to SEQ ID NO: 63664
  derived and/or modified sequence opt1 from hemagglutinin__InfluenzaA__AGR50029

SEQ ID NO: 71382 - RNA, 1701 nt, Artificial Sequence
  derived and/or modified sequence opt1 from hemagglutinin__InfluenzaA__AGR50040
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaugggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 71383 - RNA, 1701 nt, Artificial Sequence; identical to SEQ ID NO: 63664
  derived and/or modified sequence opt1 from hemagglutinin__InfluenzaA__AGR50052

SEQ ID NO: 71384 - RNA, 1701 nt, Artificial Sequence; identical to SEQ ID NO: 63664
  derived and/or modified sequence opt1 from hemagglutinin__InfluenzaA__AGR50063

SEQ ID NO: 71385 - RNA, 1701 nt, Artificial Sequence
  derived and/or modified sequence opt1 from hemagglutinin__InfluenzaA__AGR50074
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccggaaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 71386 - RNA, 1701 nt, Artificial Sequence; identical to SEQ ID NO: 63664
  derived and/or modified sequence opt1 from hemagglutinin__InfluenzaA__AGR50085

SEQ ID NO: 71387 - RNA, 1701 nt, Artificial Sequence; identical to SEQ ID NO: 63664
  derived and/or modified sequence opt1 from hemagglutinin__InfluenzaA__AGR50096

SEQ ID NO: 71388 - RNA, 1701 nt, Artificial Sequence; identical to SEQ ID NO: 63664
  derived and/or modified sequence opt1 from hemagglutinin__InfluenzaA__AGR50107

SEQ ID NO: 71389 - RNA, 1701 nt, Artificial Sequence; identical to SEQ ID NO: 63857
  derived and/or modified sequence opt1 from hemagglutinin__InfluenzaA__AGR50118

SEQ ID NO: 71390 - RNA, 1701 nt, Artificial Sequence
  derived and/or modified sequence opt1 from hemagglutinin__InfluenzaA__AGR50129
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggcagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 71391 - RNA, 1701 nt, Artificial Sequence; identical to SEQ ID NO: 63664
  derived and/or modified sequence opt1 from hemagglutinin__InfluenzaA__AGR50140

SEQ ID NO: 71392 - RNA, 1701 nt, Artificial Sequence; identical to SEQ ID NO: 63859
  derived and/or modified sequence opt1 from hemagglutinin__InfluenzaA__AGR50151

SEQ ID NO: 71393 - RNA, 1698 nt, Artificial Sequence; identical to SEQ ID NO: 67706
  derived and/or modified sequence opt1 from hemagglutinin__InfluenzaA__AGR50162

SEQ ID NO: 71394 - RNA, 1701 nt, Artificial Sequence; identical to SEQ ID NO: 63664
  derived and/or modified sequence opt1 from hemagglutinin__InfluenzaA__AGR50174

SEQ ID NO: 71395 - RNA, 1701 nt, Artificial Sequence; identical to SEQ ID NO: 63703
  derived and/or modified sequence opt1 from hemagglutinin__InfluenzaA__AGR50185

SEQ ID NO: 71396 - RNA, 1701 nt, Artificial Sequence; identical to SEQ ID NO: 63664
  derived and/or modified sequence opt1 from hemagglutinin__InfluenzaA__AGR50196

SEQ ID NO: 71397 - RNA, 1701 nt, Artificial Sequence
  derived and/or modified sequence opt1 from hemagglutinin__InfluenzaA__AGR50207
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagggcaagagcuaccccaagcuguccaagagcuacaucaacgacaaggggaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 71398 - RNA, 1701 nt, Artificial Sequence; identical to SEQ ID NO: 63664
  derived and/or modified sequence opt1 from hemagglutinin__InfluenzaA__AGR50218

SEQ ID NO: 71399 - RNA, 1701 nt, Artificial Sequence; identical to SEQ ID NO: 63664
  derived and/or modified sequence opt1 from hemagglutinin__InfluenzaA__AGR50229

SEQ ID NO: 71400 - RNA, 1701 nt, Artificial Sequence; identical to SEQ ID NO: 63859
  derived and/or modified sequence opt1 from hemagglutinin__InfluenzaA__AGR50240

SEQ ID NO: 71401 - RNA, 1701 nt, Artificial Sequence; identical to SEQ ID NO: 63717
  derived and/or modified sequence opt1 from hemagglutinin__InfluenzaA__AGR50251

SEQ ID NO: 71402 - RNA, 1701 nt, Artificial Sequence
  derived and/or modified sequence opt1 from hemagglutinin__InfluenzaA__AGR50262
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagaagacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 71403 - RNA, 1701 nt, Artificial Sequence; identical to SEQ ID NO: 63664
  derived and/or modified sequence opt1 from hemagglutinin__InfluenzaA__AGR50273

SEQ ID NO: 71404 - RNA, 1701 nt, Artificial Sequence
  derived and/or modified sequence opt1 from hemagglutinin__InfluenzaA__AGR50284
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacagccccgugcacgacugcaacaccacgugccagaccccgaagggcgccaucaacaccucccugcccuuccagaacauccaccccaucaccaucgggaagugccccaaguacgucaagagcacgaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 71405 - RNA, 1701 nt, Artificial Sequence; identical to SEQ ID NO: 64407
  derived and/or modified sequence opt1 from hemagglutinin__InfluenzaA__AGR50295

SEQ ID NO: 71406 - RNA, 1701 nt, Artificial Sequence; identical to SEQ ID NO: 63664
  derived and/or modified sequence opt1 from hemagglutinin__InfluenzaA__AGR50306

SEQ ID NO: 71407 - RNA, 1701 nt, Artificial Sequence; identical to SEQ ID NO: 63664
  derived and/or modified sequence opt1 from hemagglutinin__InfluenzaA__AGR50317

SEQ ID NO: 71408 - RNA, 1701 nt, Artificial Sequence; identical to SEQ ID NO: 71397
  derived and/or modified sequence opt1 from hemagglutinin__InfluenzaA__AGR50328

SEQ ID NO: 71409 - RNA, 1701 nt, Artificial Sequence
  derived and/or modified sequence opt1 from hemagglutinin__InfluenzaA__AGR50339
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccagcaagggcgccaucaacaccucccugccguuccagaacauccaccccaucacgaucgggaagugccccaaguacgucaagagcaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 71410 - RNA, 1701 nt, Artificial Sequence
  derived and/or modified sequence opt1 from hemagglutinin__InfluenzaA__AGR50350
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggaucauggggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 71411 - RNA, 1698 nt, Artificial Sequence
  derived and/or modified sequence opt1 from hemagglutinin__InfluenzaA__AGR50361
augaaggugcagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 71412 - RNA, 1701 nt, Artificial Sequence
  derived and/or modified sequence opt1 from hemagglutinin__InfluenzaA__AGT18718
augaaggugauccuggucgugcuccuguacaccuucgccaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccacggcggaccagcagucccuguaccagaacgccgacgccuacguguucgucggcaccagccgguacuccaagaaguucaagcccgagaucgccauccgcccgaaggugcgggaccaggagggccgcaugaacuacuacuggacccugaucgagcccggggacaagaucaccuucgaggccacgggcaaccucguggucccccgguacgcguucgccauggagcgcaacgccgggagcggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcucccuggugcucguggucagccugggggccaucagcuucuggaugugcuccaacggcagccugcagugccggaucugcaucuga

SEQ ID NO: 71413 - RNA, 1701 nt, Artificial Sequence
  derived and/or modified sequence opt1 from hemagglutinin__InfluenzaA__AGT18720
augaaggugauccuggucgugcuccuguacaccuucgccaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgucagcuccuucgagcgcuucgagaucuuccccaaggccagcuccuggcccaaccacgacagcaacaagggggugaccgccgccugcccgcacgccggcgcgaaguccuucuacaagaaccugaucuggcucgugaagaaggggaacagcuaccccaagcuguccaagagcuacaucaacgacaagggcaaggagguccuggugcucugggggauccaccaccccaacaccaccgccgaccagcagagccuguaccagaacgccgacgccuacguguucgucggcacgucccgguacagcaagaaguucaagcccgagaucgccauccgcccgaaggugcgggaccaggagcgccggaugaacuacuacuggacccugaucgagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccggagggcgccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgagaagaucgacggggugaagcucgaguccacccggaucuaccagauccuggcgaucuacagcaccgucgccuccagccuggugcucguggucucccugggcgccaucagcuucuggaugugcagcaacgggucccugcagugccgcaucugcaucuga

SEQ ID NO: 71414 - RNA, 1701 nt, Artificial Sequence
  derived and/or modified sequence opt1 from hemagglutinin__InfluenzaA__AGT18721
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucaacuacgaggagcuccgggagcagcugagcuccgugagcuccauccagcgcagcgagaucugcaccaagaccuccagcuggcccaaccacgacuccaacaagggggucaccgccgccugcccccacgccggcgccaagagcuucuacaagaaccugaucuggcucgugaagaaggggaacuccuacccgaagcugagcaagagcuacaucaacgacaagggcaaggaggugcugguccucugggggauccaccaccagaacucccggggccaccagcagagccuguaccagaacgccgacgccuacguguucgugggcacgucccgcuacagcaagaaguucaagcccgagaucgccauccggcccaaggucaaggagcaggacgggcgcauggacuacuacuggacccugaucgagcccggcgacaagaucaccuucgaggccaccgggaaccucguggugccgcgguacgcguucgccauggagcgcaacgccggcuccggcaucaucaucagcgacacgcccguccacgacugcaacacgaccugccagacccccgagggggccaucaacaccucccugcccuuccagaacauccacccgaucaccaucggcaagugccccaaguacgucaagagcaccaagcugcggcucgccaccgggcugcgcaacgugcccuccauccagagccggggccuguucggggcgaucgccggcuucaucgagggcggguggacgggcaugguggacgggugguacggcuaccaccaccagaacgagcagggguccggcuacgccgccgaccucaagagcacccagaacgccaucgacaagaucaccaacaaggugaacuccgugaucgagaagaugaacacccaguucacggcggucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggagaagaucgacggggugaagcucgaguccacccgcaucuaccagauccuggccaucuacagcaccguggcguccagccugguccucguggugagccugggcgccaucuccuucuggaugugcagcaacggcucccugcagugccggaucugcaucuga

SEQ ID NO: 71415 - RNA, 1701 nt, Artificial Sequence
  derived and/or modified sequence opt1 from hemagglutinin__InfluenzaA__AGT18722
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccaagagcaacaaccggacgugcuaccccggcgacuucaucaacuacgaggagcuccgcgagcagcuguccagcguguccagcuucgagcgguucgagaucuuccccaagaccuccagcuggcccaaccacgacuccaacaagggcgucaccgccgccugcccgcacgccggggccaagagcuucuacaagaaccugaucuggcucgugaagaagggcaacuccuaccccaagcugagcaaguccuacaucaacgacaaggggaaggaggugcugguccucuggggcauccaccaccccagcaccacggccgaccagcagagccuguaccagaacgccgacgccuacguguucguggggaccucccgcuacagcaagaaguucaagcccgagaucgccauccggccgaagguccgcgaccaggagggccggaugaacuacuacuggacccugaucgagcccggcgacaagaucaccuucgaggcgacggggaaccucguggugccccgcuacgccuucgccauggagcggaacgccggcuccgggaucaucaucagcgacacccccguccacgacugcaacacgaccugccagaccccggagggcgccaucaacaccucccugcccuuccagaacauccaccccaucaccaucggcaagugccccaaguacgucaagagcaccaagcugcgccucgcgacggggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagagcacccagaacgcgaucgacaagaucaccaacaaggugaacuccgugaucgagaagaugaacacgcaguucaccgccgucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggaaccagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgcgagaagaucgacggggugaagcucgaguccacccggaucuaccagauccuggcgaucuacagcaccguggccuccagccugguccucguggugucccugggcgccaucagcuucuggaugugcagcaacgggucccugcagugccgcaucugcaucuga

SEQ ID NO: 71416 - RNA, 1701 nt, Artificial Sequence
  derived and/or modified sequence opt1 from hemagglutinin__InfluenzaA__AGT18723
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccaagacgaacaaccggaccugcuaccccggcgacuucaucaacuacgaggagcuccgcgagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccagaacaagaaggccgagcagcagacgcccuaccagaacgccgacgccuacguguucguggggaccucccgcuacagcaagaaguucaagcccgagaucgccauccggccgaagguccgcgaccaggagggccggauggacuacuacuggacccugaucgagcccggcgacaagaucaccuucgaggcgacggggaaccugguggugccccgcuacgccuucgccauggagcggaacgccggcagcgggaucaucaucuccgacacccccguccacgacugcaacacgaccugccagaccccggagggcgccaucaacaccagccuccccuuccagaacauccaccccaucaccaucggcaagugccccaaguacgugaaguccaccaagcugcgccuggcgacggggcuccggaacgugccgagcauccagucccgcggccuguucggggccaucgccggcuucaucgagggcggguggaccggcauggucgacgggugguacggcuaccaccaccagaacgagcaggggagcggcuacgccgccgaccugaaguccacccagaacgcgaucgacaagaucaccaacaaggugaacagcgugaucgagaagaugaacacgcaguucaccgccgucgggaaggaguucaaccaccucgagaagcggaucgagaaccugaacaagaagguggacgacggcuuccuggacaucuggaccuacaacgccgagcuccugguccugcucgagaacgagcgcacccuggacuaccacgacuccaacgugaagaaccuguacgagaaggugcggaaccagcucaagaacaacgccaaggagaucggcaacgggugcuucgaguucuaccacaagugcgacaacacgugcauggagagcgucaagaacggcaccuacgacuaccccaaguacuccgaggaggccaagcugaaccgcgagaagaucgacggggugaagcuggagagcacccggaucuaccagauccucgcgaucuacuccaccguggccagcucccugguccugguggugagccucggcgccaucuccuucuggaugugcagcaacgggucccugcagugccgcaucugcaucuga

SEQ ID NO: 71417 - RNA, 1701 nt, Artificial Sequence
  derived and/or modified sequence opt1 from hemagglutinin__InfluenzaA__AGT18724
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagagccuguccaccgccagcuccuggagcuacaucguggagaccuccaagacgaacaaccggaccugcuaccccggcgacuucaucaacuacgaggagcuccgcgagcagcugagcuccgucagcuccuucgagcgguucgagaucuuccccaagaccagcuccuggcccaaccacgacagcaacaagggcgugaccgcggccugcccgcacgccggggccaaguccuucuacaagaaccugaucuggcucgugaagaagggcaacagcuaccccaagcuguccaagagcuacaucaacgacaaggggaaggagguccuggugcucuggggcauccaccaccccuccacgaccgcggaccagcagacccuguaccagaacgccgacgccuacguguucgucgggaccagccgcuacagcaagaaguucaagcccgagaucgccauccggccgaaggugcgcgaccaggagggccggaugaacuacuaccgcacgcugaucgagcccgagaacaagaucaccuucgaggccaccggcaaccucguggucccccgguacgcguucgccauggagcgcaacgccggguccggcaucaucaucagcgacacccccgugcacgacugcaacacgaccugccagaccccggagggggccaucaacaccucccugcccuuccagaacauccaccccaucacgaucggcaagugccccaaguacgucaagagcaccaagcugcggcucgccaccggccugcgcaacgugccguccauccagagccgggggcuguucggcgcgaucgccggguucaucgagggcggguggaccggcaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacagcaccgucgcguccagccuggugcucguggucucccugggggccaucagcuucuggaugugcuccaacggcagccugcagugccggaucugcaucuga

SEQ ID NO: 71418 - RNA, 1701 nt, Artificial Sequence
  derived and/or modified sequence opt1 from hemagglutinin__InfluenzaA__AGT18725
augaaggugauccuggucgugcuccuguacaccuucgccaccgccaacgcggacacgcugugcaucggcuaccacgccaacaacagcaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgucagcuccuucgagcgcuucgagaucuuccccaagaccagcuccuggcccaaccacgacagcaacaagggggugaccgccgccugcccgcacgccggcgccaaguccuucuacaagaaccugaucuggcucgugaagaaggggaacagcuaccccaagcuguccaagagcuacaucaacgacaagggcaaggagguccuggugcucugggggauccaccaccccagcaccuccgcggaccagcagagccuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgccaccggccugcgcaacgugccguccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcacccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgucaagcucgaguccacccgcaucuaccagauccuggccaucuacagcaccguggcguccagccuggugcucgucgugagccugggggccaucuccuucuggaugugcagcaacggcucccugcagugccggaucugcaucuga

SEQ ID NO: 71419 - RNA, 1701 nt, Artificial Sequence
  derived and/or modified sequence opt1 from hemagglutinin__InfluenzaA__AGT18734
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaucaacuacuacuggacccugaucgagcccggggacaagaucaccuucgaggcgacgggcaaccucguggugccccgguacgccuucgccauggagcgcaacgccgggagcggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggcgaucuacuccaccguggccagcucccugguccucguggugagccugggggccaucagcuucuggaugugcuccaacggcagccugcagugccggaucugcaucuga

SEQ ID NO: 71420 - RNA, 1701 nt, Artificial Sequence; identical to SEQ ID NO: 71131
  derived and/or modified sequence opt1 from hemagglutinin__InfluenzaA__AGT18735

SEQ ID NO: 71421 - RNA, 1701 nt, Artificial Sequence
  derived and/or modified sequence opt1 from hemagglutinin__InfluenzaA__AGT18748
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacgaggagaacugcacccugaucgacgcccugcucggcgacccccagugcgacgacuuccagaacaagaagugggaccuguucguggagcgguccaaggccuacagcaacugcuaccccuacgacgugccggacuacgcgucccugcgcagccucgucgccuccagcgggacccuggaguucaacaacgaguccuucaacugggccggcgugacgcagaacggcaccagcuccgccugccggcgcgggagcaacuccagcuucuucucccggcugaacuggcucacccaccugaacuucaaguaccccgcgcugaacgugaccaugcccaacaacgagcaguucgacaagcucuacaucuggggcguccaccaccccagcacggacaaggaccagaucuuccuguacgcccaguccagcgggcgcaucaccgugagcaccaagcggucccagcaggccgugaucccgaacaucggcagccgcccccggauccgcaacauccccucccggaucagcaucuacuggaccaucgucaagcccggggacauccugcucaucaacuccacgggcaaccugaucgccccgcgcggcuacuucaagauccggagcgggaaguccagcaucaugcgcuccgacgcccccaucggcaagugcaagagcgagugcaucacccccaacggguccauccccaacgacaagccguuccagaacgugaaccggaucaccuacggcgcgugcccccgcuacgugaagcagagcacccugaagcucgccacgggcaugcggaacguccccgagaagcagacccgcgggaucuucggcgccaucgccggguucaucgagaacggcugggaggggaugguggacggcugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacggcugcuucaagaucuaccacaagugcgacaacgccugcaucgggagcauccggaacggcacguacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggguucaucaugugggcgugccagaagggcaacauccgcugcaacaucugcaucuga

SEQ ID NO: 71422 - RNA, 1701 nt, Artificial Sequence
  derived and/or modified sequence opt1 from hemagglutinin__InfluenzaA__AGT18749
augaagaccaucaucgcccugagcuacauccucugccugguguucgcccagaagcugcccgagaacgacaacuccaccgcgacgcucugccugggccaccacgccgucccgaacgggaccaucgugaagaccaucaccgacgaccagaucgaggugacgaacgccaccgagcugguccagaacagcuccaccggcgagaucugcgacagcccccaccagauccucgacggggagaacugcacccugaucgacgcccugcucggcgacccccagugcgacggguuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggcgugacccagaacgggaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcaggccgugaucccgaacaucgggagccggccccgcguccggaacauccccagccgcaucuccaucuacuggaccaucgugaagcccggcgacauccugcucaucaacagcaccggcaaccugaucgccccgcggggguacuuccgcauccgguccggccgcagcuccaucaugcggagcgacgcccccaucgggaagugcaacuccgagugcaucacccccaacggcagcauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacuccgagggccgggggcaggccgcggaccucaagagcacgcaggccgccaucgaccagaucaacggcaagcugaaccgccugaucgggaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggcgugccagaagggcaacauccggugcaacaucugcaucuga

SEQ ID NO: 71423 - RNA, 1701 nt, Artificial Sequence
  derived and/or modified sequence opt1 from hemagglutinin__InfluenzaA__AGT18751
augaagaccgugaucgcccugagcuacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggagccucguggccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccuccgggcggaucaccgugagcacgaagcgcucccagcaggccgucaucccgaacaucggcagccggccccgcgugcggaacauccccagccgcaucuccaucuacuggaccaucgugaagcccggcgacauccugcucaucaacagcaccgggaaccugaucgccccgcggggcuacuucaagauccgcuccgggcggagcuccaucaugcgcagcgacgcccccaucggcaagugcaacuccgagugcaucacccccaacggcagcauccccaacgacaagccguuccagaacgucaaccggaucacguacggggcgugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaaguccgagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 71424 - RNA, 1701 nt, Artificial Sequence
  derived and/or modified sequence opt1 from hemagglutinin__InfluenzaA__AGT18752
augaagaccaucaucgcccugagcuacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcaacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccgggcggagcuccaucaugcgcagcgacgcccccaucggcaagugcaacuccgagugcaucacccccaacggcagcauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacuccagcgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 71425 - RNA, 1701 nt, Artificial Sequence
  derived and/or modified sequence opt1 from hemagglutinin__InfluenzaA__AGT18753
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcaacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccgggcggagcuccaucaugcgcagcgacgcccccaucggcaagugcaacuccgagugcaucacccccaacggcagcauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaaguccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 71426 - RNA, 1701 nt, Artificial Sequence
  derived and/or modified sequence opt1 from hemagglutinin__InfluenzaA__AGT18754
augaagaccaucaucgcccugagcuacauccucugccugguguucgcccagaagcugcccgagaacgacaacuccaccgcgacgcucugccugggccaccacgccgucccgaacgggaccaucgugaagaccaucaccgacgaccagaucgaggugacgaacgccaccgagcugguccagaacagcuccaccggcgagaucugcgacagcccccaccagauccucgacggggagaacugcacccugaucgacgcccugcucggcgacccccagugcgacggguuccagaacaagaagugggaccuguucguggagcgcggcaaggccuacuccaacugcuaccccuacgacgugccggacuacgcgagccugcggucccucgucgccacgagcggcacccuggaguucaacaacgaguccuucaacuggaccggggugacccagaacggcacgagcuccgccugcauccgccggagcaacaacuccuucuucagccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucacggugagcaccaagcgcucccagcaggccgugaucccgaacaucggcagccggccccgcguccggaacauccccucccgcaucagcaucuacuggaccaucgugaagcccggcgacauccugcucaucaacagcaccgggaaccugaucgccccgcggggcuacuucaagauccgcuccgggcggagcuccaucaugcgcagcgacgcccccaucggcaagugcaacuccgagugcaucacgcccaacggcagcauccccaacgacaagccguuccagaacgugaaccggaucaccuacggggcgugcccccgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 71427 - RNA, 1701 nt, Artificial Sequence
  derived and/or modified sequence opt1 from hemagglutinin__InfluenzaA__AGT18756
augaagaccaucaucgcccugagcuacgugcucugccuggucuucgcccagaagcugcccggcaacgacaacuccaccgcgacgcucugccuggggcaccacgccgugccgaacggcaccaucgugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacugggccggcgugacgcagaacgggaccagcuccgccugccggcgcggcagcaacuccagcuucuucucccggcugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccgggcgcaucaccgugagcaccaagcggagccagcaggccgucaucccgaacaucggcucccgcccccggauccgcaacauccccagccggaucuccaucuacuggaccaucgugaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgucaagcaguccacccugaagcucgccacgggcaugcggaacgugcccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaagagcgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcacguacgaccacgacgucuaccgcgacgaggcccucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 71428 - RNA, 1701 nt, Artificial Sequence
  derived and/or modified sequence opt1 from hemagglutinin__InfluenzaA__AGT18757
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccgccugccggcgcggcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccggaacggcacguacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 71429 - RNA, 1701 nt, Artificial Sequence
  derived and/or modified sequence opt1 from hemagglutinin__InfluenzaA__AGT18758
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccgccugccggcgcggcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacagcuccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacacgugcaucggguccauccggaacggcaccuacgaccacgacguguaccgcgacgaggcgcucaacaaccgguuccagaucaagggggucgagcucaagagcggcuacaaggacuggauccuguggaucagcuucgccaucuccugcuuccuggugugcguggcccugcugggcuucaucaugugggccugccagaaggggaacauccgcugcaacaucugcaucuga

SEQ ID NO: 71430 - RNA, 1701 nt, Artificial Sequence
  derived and/or modified sequence opt1 from hemagglutinin__InfluenzaA__AGT18759
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccgccugccggcgcggcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacagcuccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagagcggcuacaaggacuggauccuguggaucagcuucgccaucuccugcuuccuggugugcguggcccugcugggcuucaucaugugggccugccagaaggggaacauccgcugcaacaucugcaucuga

SEQ ID NO: 71431 - RNA, 1701 nt, Artificial Sequence
  derived and/or modified sequence opt1 from hemagglutinin__InfluenzaA__AGT18760
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcggaacaaggccuacuccaacugcuaccccuacgacgugccggacuacgcgagccugcgcucccucgucgccagcuccggcacccuggaguucaacaacgagagcuucaacugggccggcgugacgcagaacgggaccuccagcgccugccggcgcggcuccaacagcuccuucuucagccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcgggcgcaucaccguguccaccaagcggagccagcaggccgugaucccgaacaucggcagccgcccccggauccgcaacauccccucccggaucagcaucuacuggaccaucgucaagcccggcgacauccugcucaucaacuccacggggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggcgugcccccgcuacgugaagcagagcacccugaagcucgccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaaguccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagagcggcuacaaggacuggauccuguggaucuccuucgccaucagcugcuuccuggugugcguggcccugcugggcuucaucaugugggccugccagaaggggaacauccgcugcaacaucugcaucuga

SEQ ID NO: 71432 - RNA, 1701 nt, Artificial Sequence
  derived and/or modified sequence opt1 from hemagglutinin__InfluenzaA__AGT18761
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccgccugccggcgcggcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugagcaccaagcggagccagcaggccgugaucccgaacaucggcucccgcccccggauccgcaacauccccagccggaucuccaucuacuggaccaucgucaagcccggcgacauccugcucaucaacagcacggggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacagcuccgaguuccucguggcccuggagaaccagcacaccaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcacguacgaccacgacguguaccgcgacgaggcccugaacaaccgguuccagaucaagggggucgagcucaagagcggcuacaaggacuggauccuguggaucagcuucgccaucuccugcuuccuggugugcguggcccuccugggcuucaucaugugggccugccagaaggggaacauccgcugcaacaucugcaucuga

SEQ ID NO: 71433 - RNA, 1701 nt, Artificial Sequence
  derived and/or modified sequence opt1 from hemagglutinin__InfluenzaA__AGT37102
auggaggccaagcuggugguccucuucugcgccuucaccacccugaaggcggacaucaucugcgugggcuaccacgccaacaacagcacggacaccguggacaccaucauggagaagaacgucaccgugacgcacuccgugaaccugcucgagaacagccacaacgggaagcugugcucccugaacggcaaggcgccccuccagcuggggaacugcaacgucgccggcuggauccuggggaacccggagugcgaccuccugcugaccgccaacagcugguccuacaucaucgagaccagcuccagcaagaacgggaccugcuaccccggcgaguucuccgacuacgaggagcuccgcgagcugcugagcacgguguccagcuucgagcgguucgagaucuuccccaaggccaccuccuggcccaaccacgagaccaccaagggggccacgaucgccugcagccacuccggcgccagcuccuucuaccgcaaccuccuguggaucgugaagaaggggaacagcuacccgaagaucuccaagagcuacaccaacaaccggggcaaggagguccuggugaucuggggcgugcaccacccgcccaccgacagcucccagcaggcgcucuaccagaacacccacacguacaucagcgucggcuccagcaaguacuaccagcgcuucacccccgugguggccgcccggcccaagauccgcgagcaggagggccggaugaacuacuacuggacccugcuggagcagggggacaccaucacguucgaggccaccggcaaccucaucgcccccugguacgcguucgcccuggacaugggguccagcuccggcaucauggucagcgacgcccccgugcacaacugcaccaccaagugccagacgccccacggcgcccugaaguccaaccucccguuccagaacgugcaccccaucaccaucggggagugccccaaguacgucaagagcacccagcugcgcauggccaccggccugcggaacauccccuccauccagagccgcggccucuucggggcgaucgccggguucaucgagggcggcuggacggggaugaucgacggcugguacggguaccaccaccagaacgagcagggcuccggguacgccgccgaccagaaguccacccagaucgccaucgacggcaucagcaacaaggugaacagcaucaucgagaagaugaacgugcaguucaccuccgucggcaaggaguucaacgaccuggagaagcggaucgagaaccugaacaagaagguggacgacggguuccucgacguguggaccuacaacgcggagcugcugguccuccuggagaacgagcgcacgcuggacuuccacgacuucaacgugaagaaccucuacgagaaggucaagagccagcugcggaacaacgccaaggagaucggcaacgggugcuucgaguucuaccacaagugcgacaacgagugcauggagaacgugaagaacggcaccuacaacuacccgaaguacuccgaggagagcaagcugaaccgcgagaagaucgacggggugaagcucgagagcaucggcguccaccagauccuggccaucuacuccaccguggccagcucccuggugcuccuggucagccugggcgccaucuccuucuggaugugcagcaacgggucccuccagugccggaucugcaucuga

SEQ ID NO: 71434 - RNA, 1701 nt, Artificial Sequence
  derived and/or modified sequence opt1 from hemagglutinin__InfluenzaA__AGU01877
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacgaccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 71435 - RNA, 1701 nt, Artificial Sequence
  derived and/or modified sequence opt1 from hemagglutinin__InfluenzaA__AGU01878
augaaggccauccugguggucaugcucuacacccuggccaccgcgaacgccgacacgcugugcaucggcuaccacgccaacaacagcaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagagccuguccaccgccagcuccuggagcuacaucguggagaccuccggcagcgacaacggcacgugcuaccccggggacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcucgugaagaaggggaacagcuaccccaagcuguccaucagcuacaucaacgacaagggcaaggaggugcugguccucuggggcauccaccaccccuccaccacggccgaccagcagagccuguaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggcagcgggaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgagcauccagucccgggggcuguucggcgcgaucgccggcuucaucgagggcggguggaccgggaugguggacggcugguacggguaccaccaccagaacgagcagggcagcggcuacgccgccgaccucaaguccacccagaacgccaucgacaagaucacgaacaaggugaacagcgucaucgagaagaugaacacccaguucaccgcgguggggaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgcggccagcucccugguccucguggugagccugggcgccaucuccuucuggaugugcagcaacgggagccugcagugccggaucugcaucuga

SEQ ID NO: 71436 - RNA, 1701 nt, Artificial Sequence
  derived and/or modified sequence opt1 from hemagglutinin__InfluenzaA__AGU01879
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgagaagcugugcaagcuccgcggggucgcgccccugcaccugggcaagugcaacaucgccggguggauccucggcaacccggagugcgagagccuguccaccgccagcuccuggagcuacaucguggagaccuccgggagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcaggccggcgcgaagggguucuacaagaaccugaucuggcuggugaagaagggcaacagcuaccccaagcucuccaagagcuacaucaacgacaaggggaaggaggugcugguccuguggggcauccaccaccccuccaccacggccgaccagcagagccucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccagccuccccuuccagaacauccaccccaucaccaucggcaagugccccaaguacgugaaguccacgaagcugcggcuggccaccgggcuccgcaacgucccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgucgcgagcucccuggugcugguggucagccucggcgccaucuccuucuggaugugcagcaacggcagccugcagugccggaucugcaucuga

SEQ ID NO: 71437 - RNA, 1701 nt, Artificial Sequence
  derived and/or modified sequence opt1 from hemagglutinin__InfluenzaA__AGU01881
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucaacuacgaggagcuccgggagcagcugagcuccgugagcuccuucgagcgcuucgagauguuccccaagaccagcuccuggcccaaccacgacagcaacaagggcgucaccgcggccugcccgcaggccggcgccaaguccuucuacaagaaccugaucuggcucgugaagaaggggaacagcuaccccaagcuguccaagagcuacaucaacgacaagggcaaggaggugcugguccucugggggauccaccaccccagcacgaccgcggaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagagcacccgcaucuaccagauccuggccaucuacuccaccguggcgagcucccugguccucguggugagccugggggccaucagcuucuggaugugcuccaacggcagccugcagugccggaucugcaucuga

SEQ ID NO: 71438 - RNA, 1701 nt, Artificial Sequence
  derived and/or modified sequence opt1 from hemagglutinin__InfluenzaA__AGU01883
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcacgccggggcgaagggcuucuacaagaaccugaucuggcuggugaagaaggggaacagcuaccccaagcucuccaucagcuacaucaacaacaaggagaaggaggugcugguccuguggggcauccaccaccccuccaccacggccgaccagcagagccucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccagccuccccuuccagaacauccaccccaucaccaucggcaagugccccaaguacgugaaguccacgaagcugcggcuggccaccgggcuccgcaacgucccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggugaacagcgucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgcggccagcucccugguccugguggugagccucggcgccaucuccuucuggaugugcagcaacggcagccugcagugccggaucugcaucuga

SEQ ID NO: 71439 - RNA, 1701 nt, Artificial Sequence; identical to SEQ ID NO: 71068
  derived and/or modified sequence opt1 from hemagglutinin__InfluenzaA__AGU01884

SEQ ID NO: 71440 - RNA, 1701 nt, Artificial Sequence
  derived and/or modified sequence opt1 from hemagglutinin__InfluenzaA__AGU01885
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgagaagcugugcaagcuccgcggggucgcgccccugcaccugggcaagugcaacaucgccggguggauccucggcaacccggagugcgagagccuguccaccgccagcuccuggagcuacaucguggagaccuccgggagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcaggccggcgcgaagggguucuacaagaaccugaucuggcuggugaagaagggcaacagcuaccccaagcucuccaagagcuacaucaacgacaaggggaaggaggugcugguccuguggggcauccaccaccccuccaccacggccgaccagcagagccucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccagccuccccuuccagaacgugcaccccaucaccaucggcaagugccccaaguacgucaaguccacgaagcugcggcuggccaccgggcuccgcaacgugccgagcauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggucaacagcgugaucgagaagaugaacacccaguucaccgcggucggcaaggaguucaaccaccucgagaagcgcaucgagaaccugaacaagaagguggacgacggguuccuggacaucuggaccuacaacgccgagcuccuggugcugcucgagaacgagcggacgcuggacuaccacgacuccaacgucaagaaccuguacgagaaggugcgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcuggagagcacccgcaucuaccagauccucgccaucuacuccaccguggcgagcucccuggugcuggucgugagccucggcgccaucuccuucuggaugugcagcaacggcagccugcagugccggaucugcaucuga

SEQ ID NO: 71441 - RNA, 1701 nt, Artificial Sequence
  derived and/or modified sequence opt1 from hemagglutinin__InfluenzaA__AGU01887
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccacggccgaccagcagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccgucgagcgcaacgccgggagcggcaucaucaucuccgacacccccgugcacaacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacagcgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggcgaucuacuccaccgucgccagcucccuggugcucguggucagccugggggccaucagcuucuggaugugcuccaacggcagccugcagugccggaucugcaucuga

SEQ ID NO: 71442 - RNA, 1701 nt, Artificial Sequence
  derived and/or modified sequence opt1 from hemagglutinin__InfluenzaA__AGU01888
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcaggccggggcgaagggcuucuacaagaaccugaucuggcuggugaagaaggggaacagcuaccccaagcucuccaagagcuacaucaacgacaagggcaaggaggugcugguccuguggggcauccaccaccccuccaccacggccgaccagcagagccucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccgcuucaccgcgguggggaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagagcacccggaucuaccagauccucgccaucuacuccaccgucgcgagcucccuggugcugguggucagccucggcgccaucuccuucuggaugugcagcaacgggagccugcagugccgcaucugcaucuga

SEQ ID NO: 71443 - RNA, 1701 nt, Artificial Sequence; identical to SEQ ID NO: 71434
  derived and/or modified sequence opt1 from hemagglutinin__InfluenzaA__AGU01889

SEQ ID NO: 71444 - RNA, 1701 nt, Artificial Sequence
  derived and/or modified sequence opt1 from hemagglutinin__InfluenzaA__AGU01890
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccggcagcgacaacggcacgugcuaccccggggacuucaucgacuacgaggagcugcgggagcagcucuccagcguguccagcuucgagcgcuucgagaucuuccccaagaccuccagcuggcccaaccacgacuccaacaagggcgucaccgccgccugcccgcaggccggggcgaagggcuucuacaagaaccugaucuggcuggugaagaaggggaacagcuaccccaagcucuccaagagcuacaucaacgacaagggcaaggaggugcugguccuguggggcauccaccaccccuccaccacggccgaccagcagagccucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcagcgggaucaucaucuccgacacccccgugcacgacugcaacaccacgugccagaccccgaagggcgccaucaacaccagccuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcagcggcuacgccgccgaccugaaguccacccagaacgccaucgacaagaucacgaacaaggugaacagcgucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgccaucuacuccaccgucgcgagcucccuggugcugguggucagccucggcgccaucuccuucuggaugugcagcaacgggagccugcagugccggaucugcaucuga

SEQ ID NO: 71445 - RNA, 1701 nt, Artificial Sequence
  derived and/or modified sequence opt1 from hemagglutinin__InfluenzaA__AGU92645
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgagacgcgcccgaagguccgggaccaggaggggcgcaugaacuacuacuggacccugguggagcccggcgacaagaucaccuucgaggccaccgggaaccucguggucccccgguacgccuucgcgauggagcgcgacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgucccgagcauccagucccggggccuguucggggccaucgcgggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgccgcgagcucccugguccucguggugagccugggcgccaucuccuucuggaugugcagcaacggcagccugcagugccggaucugcaucuga

SEQ ID NO: 71446 - RNA, 1701 nt, Artificial Sequence
  derived and/or modified sequence opt1 from hemagglutinin__InfluenzaA__AGU92667
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccucguggucccccgguacgcguucgccauggagcgcgacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgucccgagcauccagucccggggccuguucggggcgaucgccggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcgggcccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgccgccagcucccugguccucguggugagccugggcgccaucuccuucuggaugugcagcaacggcagccugcagugccggaucugcaucuga

SEQ ID NO: 71447 - RNA, 1701 nt, Artificial Sequence
  derived and/or modified sequence opt1 from hemagglutinin__InfluenzaA__AGU92678
augaaggccauccuggugguccuccuguacaccuucgccaccgcgaacgccgacacgcugugcaucggccaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccucguggucccccgguacgcguucgccauggagcgcgacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgucccgagcauccagucccggggccuguucggggcgaucgccggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgcggccagcucccugguccucguggugagccugggcgccaucuccuucuggaugugcagcaacggcagccugcagugccggaucugcaucuga

SEQ ID NO: 71448 - RNA, 1701 nt, Artificial Sequence
  derived and/or modified sequence opt1 from hemagglutinin__InfluenzaA__AGU92711
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagcaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 71449 - RNA, 1701 nt, Artificial Sequence
  derived and/or modified sequence opt1 from hemagglutinin__InfluenzaA__AGU92722
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 71450 - RNA, 1701 nt, Artificial Sequence; identical to SEQ ID NO: 71449
  derived and/or modified sequence opt1 from hemagglutinin__InfluenzaA__AGU92733

SEQ ID NO: 71451 - RNA, 1701 nt, Artificial Sequence
  derived and/or modified sequence opt1 from hemagglutinin__InfluenzaA__AGU92744
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacggggccuacgacuaccccaaguacagcgaggaggcgaagcugaaccgggaggagaucgacggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 71452 - RNA, 1701 nt, Artificial Sequence
  derived and/or modified sequence opt1 from hemagglutinin__InfluenzaA__AGU92755
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaaggaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 71453 - RNA, 1701 nt, Artificial Sequence
  derived and/or modified sequence opt1 from hemagglutinin__InfluenzaA__AGU92766
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgaguccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacgccuacguguucgugggcaccagccgguacuccaagaaguucaagcccgagaucgccacccgcccgaagguccgggaccaggaggggcgcaugaacuacuacuggacgcugguggagcccggcgacaagaucaccuucgaggcgaccgggaaccucguggucccccgguacgccuucgccauggagcgcgacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacaagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgccgccagcucccugguccucguggugagccugggcgccaucuccuucuggaugugcagcaacggcagccugcagugccggaucugcaucuga

SEQ ID NO: 71454 - RNA, 1701 nt, Artificial Sequence
  derived and/or modified sequence opt1 from hemagglutinin__InfluenzaA__AGU92777
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgaguccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagcaucuaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccugguggucccccgguacgcguucgccauggagcgcgacgccggcagcggcaucaucaucuccgacacgcccgugcacgacugcaacacgaccugccagaccccgaagggggccaucaacaccagccuccccuuccagaacauccaccccaucaccaucggcaagugccccaaguacgugaaguccaccaagcugcggcuggccaccgggcuccgcaacgucccgagcauccagucccggggccuguucggggcgaucgccggcuucaucgagggcggguggacgggcaugguggacgggugguacggcuaccaccaccagaacgagcaggggagcggcuacgccgccgaccugaaguccacccagaacgccaucgacaagaucaccaacaaggugaacagcgucaucgagaagaugaacacccaguucacggcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagagcacccgcaucuaccagauccucgccaucuacuccaccgcggccagcucccugguccugguggugagccucggcgccaucuccuucuggaugugcagcaacggcagccugcagugccggaucugcaucuga

SEQ ID NO: 71455 - RNA, 1701 nt, Artificial Sequence
  derived and/or modified sequence opt1 from hemagglutinin__InfluenzaA__AGU92788
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccgacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacgccuacguguucgugggcaccagccgguacuccaagaaguucaagcccgagaucgccacccgcccgaagguccgggaccgcgaggggcggaugaacuacuacuggacgcugguggagcccggcgacaagaucaccuucgaggcgaccgggaaccucguggucccccgcuacgccuucgccauggagcgggacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugcucgacgggugguacggcuaccaccaccagaacgagcaggggagcggcuacgccgccgaccugaaguccacgcagaacgcgaucgacaagaucaccaacaaggugaacagcgugaucgagaagaugaacacccaguucaccgccgucggcaaggaguucaaccaccuggagaagcggaucgagaaccucaacaagaagguggacgacggguuccuggacaucuggacguacaacgccgagcugcucguccugcuggagaacgagcgcacccucgacuaccacgacuccaacgugaagaaccuguacgagaaggugcggaaccagcugaagaacaacgccaaggagaucggcaacgggugcuucgaguucuaccacaagugcgacaacacgugcauggagagcgucaagaacggcaccuacgacuaccccaaguacuccgaggaggccaagcucaaccgcgaggagaucgacggggugaagcuggagagcacccggaucuaccagauccuggcgaucuacuccaccgccgccagcucccucgugcuggucgugagccugggcgccaucuccuucuggaugugcagcaacggcagccuccagugccgcaucugcaucuga

SEQ ID NO: 71456 - RNA, 1701 nt, Artificial Sequence
  derived and/or modified sequence opt1 from hemagglutinin__InfluenzaA__AGU92799
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccgaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacgccuacguguucgugggcaccagccgguacuccaagaaguucaagcccgagaucgccacccgcccgaagguccgggaccgcgaggggcggaugaacuacuacuggacgcugguggagcccggcgacaagaucaccuucgaggcgaccgggaaccucguggucccccgcuacgccuucgccauggagcgggacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacaagaucaccaacaaggugaacagcgucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgccgccagcucccugguccucguggugagccugggcgccaucuccuucuggaugugcagcaacggcagccugcagugccgcaucugcaucuga

SEQ ID NO: 71457 - RNA, 1701 nt, Artificial Sequence
  derived and/or modified sequence opt1 from hemagglutinin__InfluenzaA__AGU92821
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagauguucaagcccgagaucgccacgcgcccgaagguccgggaccgcgaggggcggaugaacuacuacuggacccugguggagcccggcgacaagaucaccuucgaggccaccgggaaccucguggucccccgcuacgcguucgccauggagcgggacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcgccucgccaccgggcugcggaacgucccgagcauccagucccgcggccuguucggggcgaucgccggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggcggugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggccaucuacuccaccgcggccagcucccugguccucguggugagccugggcgccaucuccuucuggaugugcagcaacggcagccugcagugccgcaucugcaucuga

SEQ ID NO: 71458 - RNA, 1701 nt, Artificial Sequence
  derived and/or modified sequence opt1 from hemagglutinin__InfluenzaA__AGU92843
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaagggggacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 71459 - RNA, 1710 nt, Artificial Sequence
  derived and/or modified sequence opt1 from hemagglutinin__InfluenzaA__AGU92854
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcgacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugacgucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagagcacccggaucuaccagauccuggcgaucuacagcaccgucgccuccagccucgugcugguggucucccugggggccaucagcuucuggaugugcuccaacggcagccuccagugccgcaucugcaucuga

SEQ ID NO: 71460 - RNA, 1701 nt, Artificial Sequence
  derived and/or modified sequence opt1 from hemagglutinin__InfluenzaA__AGU92887
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgacgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgcguucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgagcauccagucccgcgggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggccaucuacagcaccgucgcgagcucccuggugcucguggucagccugggggccaucuccuucuggaugugcagcaacggcucccugcagugccgcaucugcaucuga

SEQ ID NO: 71461 - RNA, 1701 nt, Artificial Sequence; identical to SEQ ID NO: 71445
  derived and/or modified sequence opt1 from hemagglutinin__InfluenzaA__AGU92898

SEQ ID NO: 71462 - RNA, 1701 nt, Artificial Sequence; identical to SEQ ID NO: 71446
  derived and/or modified sequence opt1 from hemagglutinin__InfluenzaA__AGU92909

SEQ ID NO: 71463 - RNA, 1701 nt, Artificial Sequence; identical to SEQ ID NO: 71448
  derived and/or modified sequence opt1 from hemagglutinin__InfluenzaA__AGU92931

SEQ ID NO: 71464 - RNA, 1701 nt, Artificial Sequence; identical to SEQ ID NO: 71449
  derived and/or modified sequence opt1 from hemagglutinin__InfluenzaA__AGU92942

SEQ ID NO: 71465 - RNA, 1701 nt, Artificial Sequence; identical to SEQ ID NO: 71449
  derived and/or modified sequence opt1 from hemagglutinin__InfluenzaA__AGU92953

SEQ ID NO: 71466 - RNA, 1701 nt, Artificial Sequence
  derived and/or modified sequence opt1 from hemagglutinin__InfluenzaA__AGU92964
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacgccuacguguucgugggcaccagccgguacuccaagaaguucaagcccgagaucgccacccgcccgaagguccgggaccgcgaggggcggaugaacuacuacuggacgcugguggagcccggcgacaagaucaccuucgaggcgaccgggaaccucguggucccccgcuacgccuucgccauggagcgggacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugcucgacgggugguacggcuaccaccaccagaacgagcaggggagcggcuacgccgccgaccugaaguccacgcagaacgcgaucgacaagaucaccaacaaggugaacagcgugaucgagaagaugaacacccaguucaccgccgucggcaaggaguucaaccaccuggagaagcggaucgagaaccucaacaagaagguggacgacggguuccuggacaucuggacguacaacgccgagcugcucguccugcuggagaacgagcgcacccucgacuaccacgacuccaacgugaagaaccuguacgagaaggugcggaaccagcugaagaacaacgccaaggagaucggcaacgggugcuucgaguucuaccacaagugcgacaacacgugcauggagagcgucaagaacggcaccuacgacuaccccaaguacuccgaggaggccaagcucaaccgcgaggagaucgacggggugaagcuggagagcacccggaucuaccagauccuggcgaucuacuccaccgccgccagcucccucgugcuggucgugagccugggcgccaucuccuucuggaugugcagcaacggcagccuccagugccgcaucugcaucuga

SEQ ID NO: 71467 - RNA, 1701 nt, Artificial Sequence
  derived and/or modified sequence opt1 from hemagglutinin__InfluenzaA__AGU92975
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaaggagaacagcuaccccaagcuguccaagagcuacaucaacgacaagggcaaggaggugcugguccucugggggauccaccaccccuccacgaccgccgaccagcagagccuguaccagaacgccgacaccuacguguucgugggcaccagccgguacuccaagaaguucaagcccgagaucgccacgcgcccgaagguccgggaccgcgagggccggaugaacuacuacuggacccugguggagcccggggacaagaucaccuucgaggccaccggcaaccucguggucccccgcuacgcguucgccauggagcgggacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgccaccggccugcggaacgucccgagcauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacagcgucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggccaucuacuccaccgcggccagcucccugguccucguggugagccugggggccaucuccuucuggaugugcagcaacggcagccugcagugccgcaucugcaucuga

SEQ ID NO: 71468 - RNA, 1701 nt, Artificial Sequence; identical to SEQ ID NO: 71458
  derived and/or modified sequence opt1 from hemagglutinin__InfluenzaA__AGU92986

SEQ ID NO: 71469 - RNA, 1701 nt, Artificial Sequence
  derived and/or modified sequence opt1 from hemagglutinin__InfluenzaA__AGU92997
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagauguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 71470 - RNA, 1701 nt, Artificial Sequence; identical to SEQ ID NO: 71460
  derived and/or modified sequence opt1 from hemagglutinin__InfluenzaA__AGU93008

SEQ ID NO: 71471 - RNA, 1698 nt, Artificial Sequence; identical to SEQ ID NO: 67562
  derived and/or modified sequence opt1 from hemagglutinin__InfluenzaA__AGU93019

SEQ ID NO: 71472 - RNA, 1701 nt, Artificial Sequence; identical to SEQ ID NO: 68058
  derived and/or modified sequence opt1 from hemagglutinin__InfluenzaA__AGU93031

SEQ ID NO: 71473 - RNA, 1701 nt, Artificial Sequence
  derived and/or modified sequence opt1 from hemagglutinin__InfluenzaA__AGU93042
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccaacuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcacgaccgccgaccagcagucccuguaccagaacgccgacaccuacguguucgugggcaccagccgguacagcaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcuccggcaucaucaucagcgacacccccgugcacgacugcaacacgaccugccagaccccgaagggggccaucaacaccucccugcccuuccagaacauccaccccaucacgaucggcaagugccccaaguacgucaagagcaccaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacauccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgcggccuccagccugguccucguggugucccugggcgccaucagcuucuggaugugcuccaacggcagccugcagugccggaucugcaucuga

SEQ ID NO: 71474 - RNA, 1701 nt, Artificial Sequence
  derived and/or modified sequence opt1 from hemagglutinin__InfluenzaA__AGU93053
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugagcaccgccuccagcugguccuacaucguggagacgagcuccagcgacaacgggaccugcuaccccggcgacuucaucgacuacgaggagcuccgggagcagcuguccagcguguccagcuucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacagcuaccccaagcuguccaagagcuacaucaacgacaaggggaaggaggugcugguccucuggggcauccaccaccccuccacgaccgccgaccagcagagccuguaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccucguggucccccgguacgcguucgccauggagcgcgacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgucccgagcauccagucccggggccuguucggggcgaucgccggcuucaucgagggcggguggacgggcaugguggacgggugguacggcuaccaccaccagaacgagcaggggagcggcuacgccgccgaccucaaguccacccagaacgccaucgacaagaucaccaacaaggugaacagcgucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgcggccagcucccugguccucguggugagccugggcgccaucuccuucuggaugugcagcaacggcagccugcagugccggaucugcaucuga

SEQ ID NO: 71475 - RNA, 1701 nt, Artificial Sequence
  derived and/or modified sequence opt1 from hemagglutinin__InfluenzaA__AGV99014
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 71476 - RNA, 1701 nt, Artificial Sequence; identical to SEQ ID NO: 71002
  derived and/or modified sequence opt1 from hemagglutinin__InfluenzaA__AGV99037

SEQ ID NO: 71477 - RNA, 1701 nt, Artificial Sequence
  derived and/or modified sequence opt1 from hemagglutinin__InfluenzaA__AGV99049
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcagccucguggccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccagcgggcgcaucaccguguccaccaagcggagccagcaggccgucaucccgaacaucggcagccgcccccggauccgcaacauccccucccggaucagcaucuacuggacgaucgugaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgucaagcagagcacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacggcaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcgugguccugcucggguucaucaugugggccugccagaagggcaacauccgcugcaacaucugcaucuga

SEQ ID NO: 71478 - RNA, 1701 nt, Artificial Sequence
  derived and/or modified sequence opt1 from hemagglutinin__InfluenzaA__AGV99073
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccgggggagcaacuccagcuucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcugaucaacagcaccggcaaccucaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagacgaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagcccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 71479 - RNA, 1701 nt, Artificial Sequence; identical to SEQ ID NO: 70866
  derived and/or modified sequence opt1 from hemagglutinin__InfluenzaA__AGV99085

SEQ ID NO: 71480 - RNA, 1701 nt, Artificial Sequence
  derived and/or modified sequence opt1 from hemagglutinin__InfluenzaA__AGV99097
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagauccucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71481 - RNA, 1701 nt, Artificial Sequence
  derived and/or modified sequence opt1 from hemagglutinin__InfluenzaA__AGV99121
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggcgugacgcagaacgggaccagcuccgccugcauccggggcagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcggaucaccgugagcaccaagcgcagccagcaggccgugaucccgaacaucggcucccggccccgcauccggaacauccccagccgcaucuccaucuacuggaccaucgucaagcccggcgacauccugcucaucaacagcacggggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggcgugcccccgguacgugaagcaguccacccugaagcucgccacgggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 71482 - RNA, 1701 nt, Artificial Sequence; identical to SEQ ID NO: 71481
  derived and/or modified sequence opt1 from hemagglutinin__InfluenzaA__AGV99133

SEQ ID NO: 71483 - RNA, 1701 nt, Artificial Sequence; identical to SEQ ID NO: 71475
  derived and/or modified sequence opt1 from hemagglutinin__InfluenzaA__AGV99145

SEQ ID NO: 71484 - RNA, 1701 nt, Artificial Sequence
  derived and/or modified sequence opt1 from hemagglutinin__InfluenzaA__AGV99157
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcagccucguggccuccagcggcacccuggaguucaacaacgaguccuucaacuggacgggggucacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcugaucaacagcaccgggaaccucaucgccccgcgcggcuacuucaagauccgguccggcaagagcuccaucaugcgcagcgacacccccaucgggaagugcaaguccgagugcaucacccccaacggcagcauccccaacgacaagccguuccagaacgucaaccggaucacguacggggccugcccccgcuacgugaagcaguccacccugaagcuggccaccggcaugcggaacgugcccgagaagcagacccgcgggaucuucggcgcgaucgccggguucaucgagaacggcugggagggcaugauggacgggugguacggcuuccggcaccagaacagcgaggggcgcggccaggccgccgaccucaaguccacgcaggccgcgaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccggaacggcaccuacgaccacgacgucuaccgcgacgaggcgcugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71485 - RNA, 1701 nt, Artificial Sequence; identical to SEQ ID NO: 71002
  derived and/or modified sequence opt1 from hemagglutinin__InfluenzaA__AGV99169

SEQ ID NO: 71486 - RNA, 1701 nt, Artificial Sequence; identical to SEQ ID NO: 71475
  derived and/or modified sequence opt1 from hemagglutinin__InfluenzaA__AGV99181

SEQ ID NO: 71487 - RNA, 1701 nt, Artificial Sequence
  derived and/or modified sequence opt1 from hemagglutinin__InfluenzaA__AGV99193
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcugaucaacagcaccgggaaccucaucgccccgcgcggcuacuucaagauccgguccggcaagagcuccaucaugcgcagcgacacccccaucgggaagugcaaguccgagugcaucacccccaacggcagcauccccaacgacaagccguuccagaacgugaaccggaucacguacggggccugcccccgcuacgugaagcaguccacccugaagcuggccaccggcaugcggaacguccccgagaagcagacccgcgggaucuucggcgcgaucgccggguucaucgagaacggcugggagggcaugauggacgggugguacggcuuccggcaccagaacagcgaggggcgcggccaggccgccgaccucaaguccacgcaggccgcgaucgaccagaucaacgggaagcugaaccggcugaucggcaagaccaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 71488 - RNA, 1701 nt, Artificial Sequence; identical to SEQ ID NO: 70876
  derived and/or modified sequence opt1 from hemagglutinin__InfluenzaA__AGV99956

SEQ ID NO: 71489 - RNA, 1701 nt, Artificial Sequence
  derived and/or modified sequence opt1 from hemagglutinin__InfluenzaA__AGV99986
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucaucgccuccagcggcacccuggaguucaacaacgaguccuucaacuggacgggggucacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71490 - RNA, 1701 nt, Artificial Sequence
  derived and/or modified sequence opt1 from hemagglutinin__InfluenzaA__AGW00065
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacaccucccugcgcagccucgucgcguccagcggcacgcuggaguucaacaacgaguccuucaacuggaccggggugacccagaacggcaccagcuccgccugcauccggcgcagcaacuccagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggagccagcaggcggugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 71491 - RNA, 1701 nt, Artificial Sequence; identical to SEQ ID NO: 71002
  derived and/or modified sequence opt1 from hemagglutinin__InfluenzaA__AGW00077

SEQ ID NO: 71492 - RNA, 1701 nt, Artificial Sequence; identical to SEQ ID NO: 70866
  derived and/or modified sequence opt1 from hemagglutinin__InfluenzaA__AGW00089

SEQ ID NO: 71493 - RNA, 1701 nt, Artificial Sequence; identical to SEQ ID NO: 71002
  derived and/or modified sequence opt1 from hemagglutinin__InfluenzaA__AGW00101

SEQ ID NO: 71494 - RNA, 1701 nt, Artificial Sequence
  derived and/or modified sequence opt1 from hemagglutinin__InfluenzaA__AGW00113
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaccuuccuguacgcccagagcuccggccggaucaccgugagcaccaagcgcagccagcaggccgugaucccgaacaucggcucccggccccgcauccggaacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71495 - RNA, 1701 nt, Artificial Sequence; identical to SEQ ID NO: 71002
  derived and/or modified sequence opt1 from hemagglutinin__InfluenzaA__AGW00125

SEQ ID NO: 71496 - RNA, 1701 nt, Artificial Sequence; identical to SEQ ID NO: 71002
  derived and/or modified sequence opt1 from hemagglutinin__InfluenzaA__AGW00137

SEQ ID NO: 71497 - RNA, 1701 nt, Artificial Sequence; identical to SEQ ID NO: 71002
  derived and/or modified sequence opt1 from hemagglutinin__InfluenzaA__AGW00149

SEQ ID NO: 71498 - RNA, 1701 nt, Artificial Sequence; identical to SEQ ID NO: 71002
  derived and/or modified sequence opt1 from hemagglutinin__InfluenzaA__AGW00161

SEQ ID NO: 71499 - RNA, 1701 nt, Artificial Sequence; identical to SEQ ID NO: 71002
  derived and/or modified sequence opt1 from hemagglutinin__InfluenzaA__AGW00173

SEQ ID NO: 71500 - RNA, 1701 nt, Artificial Sequence
  derived and/or modified sequence opt1 from hemagglutinin__InfluenzaA__AGW00185
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcagccucguggccuccagcggcacccuggaguucaacaacgaguccuucaacuggacgggggucacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucagcaccaagcggagccagcaggccgugaucccgaacaucggcucccgcccccggauccgcaacauccccagccggaucuccaucuacuggacgaucgugaagcccggcgacauccugcugaucaacagcaccgggaaccucaucgccccgcgcggcuacuucaagauccgguccggcaagagcuccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71501 - RNA, 1701 nt, Artificial Sequence; identical to SEQ ID NO: 71002
  derived and/or modified sequence opt1 from hemagglutinin__InfluenzaA__AGW00709

SEQ ID NO: 71502 - RNA, 1701 nt, Artificial Sequence; identical to SEQ ID NO: 71002
  derived and/or modified sequence opt1 from hemagglutinin__InfluenzaA__AGW00721

SEQ ID NO: 71503 - RNA, 1701 nt, Artificial Sequence; identical to SEQ ID NO: 71002
  derived and/or modified sequence opt1 from hemagglutinin__InfluenzaA__AGW00733

SEQ ID NO: 71504 - RNA, 1701 nt, Artificial Sequence; identical to SEQ ID NO: 71002
  derived and/or modified sequence opt1 from hemagglutinin__InfluenzaA__AGW00745

SEQ ID NO: 71505 - RNA, 1701 nt, Artificial Sequence
  derived and/or modified sequence opt1 from hemagglutinin__InfluenzaA__AGW00757
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaaccugaaccgcaucaccuacggcgcgugcccccgguacgugaagcaguccacccucaagcuggccacggggaugcgcaacgugcccgagaagcagacccggggcaucuucggggccaucgccggcuucaucgagaacggcugggaggggauggucgacggcugguacggguuccgccaccagaacagcgagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacguggaggacacgaagaucgaccucugguccuacaacgccgagcugcuggucgcccucgagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcugugcgucgcccuccugggguucaucaugugggcgugccagaagggcaacauccggugcaacaucugcaucuga

SEQ ID NO: 71506 - RNA, 1701 nt, Artificial Sequence; identical to SEQ ID NO: 71005
  derived and/or modified sequence opt1 from hemagglutinin__InfluenzaA__AGW00769

SEQ ID NO: 71507 - RNA, 1701 nt, Artificial Sequence; identical to SEQ ID NO: 70891
  derived and/or modified sequence opt1 from hemagglutinin__InfluenzaA__AGW00781

SEQ ID NO: 71508 - RNA, 1701 nt, Artificial Sequence; identical to SEQ ID NO: 71490
  derived and/or modified sequence opt1 from hemagglutinin__InfluenzaA__AGW00793

SEQ ID NO: 71509 - RNA, 1701 nt, Artificial Sequence; identical to SEQ ID NO: 71002
  derived and/or modified sequence opt1 from hemagglutinin__InfluenzaA__AGW00805

SEQ ID NO: 71510 - RNA, 1701 nt, Artificial Sequence; identical to SEQ ID NO: 70843
  derived and/or modified sequence opt1 from hemagglutinin__InfluenzaA__AGW00817

SEQ ID NO: 71511 - RNA, 1701 nt, Artificial Sequence; identical to SEQ ID NO: 71489
  derived and/or modified sequence opt1 from hemagglutinin__InfluenzaA__AGW00829

SEQ ID NO: 71512 - RNA, 1701 nt, Artificial Sequence
  derived and/or modified sequence opt1 from hemagglutinin__InfluenzaA__AGW00841
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgggcgcaucgaggugacgaacgccaccgagcugguccagaacagcuccaucggcgagaucugcgacagcccccaccagauccucgacggggagaacugcacccugaucgacgcccugcucggcgacccccagugcgacggcuuccagaacaagaagugggaccuguucguggagcgguccaaggccuacagcaacugcuaccccuacgacgugccggacuacgcgucccugcgcagccucgucgccuccagcgggacccuggaguucaacaacgaguccuucaacugggccggcgugacgcagaacgggaccagcuccgccugcauccggggcagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucgggucccggccccgcauccggaacauccccagccgcaucuccaucuacuggaccaucgucaagcccggcgacauccugcucaucaacagcacggggaaccugaucgccccgcggggcuacuucaagauccgcuccggcaagagcuccaucaugcggagcgacgcccccaucgggaagugcaaguccgagugcaucacccccaacggcagcauccccaacgacaagccguuccagaacgugaaccgcaucaccuacggggcgugcccccgguacgugaagcaguccacccugaagcucgccacgggcaugcgcaacguccccgagaagcagacccgggggaucuucggcgccaucgccggcuucaucgagaacgggugggagggcaugguggacgggugguacggcuuccgccaccagaacagcgaggggcggggccaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggcgucgagcucaagagcggguacaaggacuggauccuguggaucuccuucgccaucagcugcuuccugcugugcguggcccugcucggcuucaucaugugggcgugccagaaggggaacauccggugcaacaucugcaucuga

SEQ ID NO: 71513 - RNA, 1701 nt, Artificial Sequence
  derived and/or modified sequence opt1 from hemagglutinin__InfluenzaA__AGW00853
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagccgagcgggcgcaucaccguguccaccaagcggagccagcaggccgugauccccaacaucggcagccgcccccggauccgcaacauccccucccggaucagcaucuacuggacgaucgucaagccgggcgacauccugcucaucaacuccaccgggaaccugaucgcgccccgcggcuacuucaagauccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcagagcacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 71514 - RNA, 1701 nt, Artificial Sequence; identical to SEQ ID NO: 70866
  derived and/or modified sequence opt1 from hemagglutinin__InfluenzaA__AGW00865

SEQ ID NO: 71515 - RNA, 1701 nt, Artificial Sequence
  derived and/or modified sequence opt1 from hemagglutinin__InfluenzaA__AGW00877
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcuuccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71516 - RNA, 1701 nt, Artificial Sequence
  derived and/or modified sequence opt1 from hemagglutinin__InfluenzaA__AGW00889
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacugggugcuguggaucuccuucgccaucagcugcuuccugcugugcguggcccugcucggcuucaucaugugggccugccagaaggggaacauccgcugcaacaucugcaucuga

SEQ ID NO: 71517 - RNA, 1701 nt, Artificial Sequence; identical to SEQ ID NO: 70866
  derived and/or modified sequence opt1 from hemagglutinin__InfluenzaA__AGW00901

SEQ ID NO: 71518 - RNA, 1701 nt, Artificial Sequence; identical to SEQ ID NO: 70866
  derived and/or modified sequence opt1 from hemagglutinin__InfluenzaA__AGW00913

SEQ ID NO: 71519 - RNA, 1701 nt, Artificial Sequence; identical to SEQ ID NO: 71002
  derived and/or modified sequence opt1 from hemagglutinin__InfluenzaA__AGW00931

SEQ ID NO: 71520 - RNA, 1701 nt, Artificial Sequence; identical to SEQ ID NO: 71002
  derived and/or modified sequence opt1 from hemagglutinin__InfluenzaA__AGW01244

SEQ ID NO: 71521 - RNA, 1701 nt, Artificial Sequence; identical to SEQ ID NO: 70876
  derived and/or modified sequence opt1 from hemagglutinin__InfluenzaA__AGW01256

SEQ ID NO: 71522 - RNA, 1701 nt, Artificial Sequence
  derived and/or modified sequence opt1 from hemagglutinin__InfluenzaA__AGW01295
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagauccucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 71523 - RNA, 1701 nt, Artificial Sequence; identical to SEQ ID NO: 70866
  derived and/or modified sequence opt1 from hemagglutinin__InfluenzaA__AGW01307

SEQ ID NO: 71524 - RNA, 1701 nt, Artificial Sequence
  derived and/or modified sequence opt1 from hemagglutinin__InfluenzaA__AGW01319
augaagaccaucaucgcccugagcuacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaacaagcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 71525 - RNA, 1701 nt, Artificial Sequence
  derived and/or modified sequence opt1 from hemagglutinin__InfluenzaA__AGW01331
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgagcacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71526 - RNA, 1701 nt, Artificial Sequence; identical to SEQ ID NO: 71002
  derived and/or modified sequence opt1 from hemagglutinin__InfluenzaA__AGW01343

SEQ ID NO: 71527 - RNA, 1701 nt, Artificial Sequence; identical to SEQ ID NO: 71005
  derived and/or modified sequence opt1 from hemagglutinin__InfluenzaA__AGW01355

SEQ ID NO: 71528 - RNA, 1701 nt, Artificial Sequence; identical to SEQ ID NO: 70876
  derived and/or modified sequence opt1 from hemagglutinin__InfluenzaA__AGW01367

SEQ ID NO: 71529 - RNA, 1701 nt, Artificial Sequence; identical to SEQ ID NO: 71002
  derived and/or modified sequence opt1 from hemagglutinin__InfluenzaA__AGW01391

SEQ ID NO: 71530 - RNA, 1701 nt, Artificial Sequence
  derived and/or modified sequence opt1 from hemagglutinin__InfluenzaA__AGW01403
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccggggagaucugcaacagcccccaccagauccucgacggcgagaacugcacccugaucgacgcccugcucggggacccccagugcgacggcuuccagaacaagaagugggaccuguucgucgagcgcagcaaggcccacuccaacugcuaccccuacgacgugccggacuacgcgagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccgccgggcggaucaccgucagcacgaagcgcucccagcaggccgugaucccgaacaucggcagccggccccgcgugcggaacauccccagccgcgucuccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacuacgucuaccgggacgaggcccucaacaaccgcuuccagaucaaggggguggagcugaaguccggcuacaaggacuggauccuguggaucagcuucgcgaccuccugcuuccuccugugcguggcccugcucggcuucaucaugugggccugccagaaggggaacauccggugcaacaucugcaucuga

SEQ ID NO: 71531 - RNA, 1701 nt, Artificial Sequence; identical to SEQ ID NO: 70866
  derived and/or modified sequence opt1 from hemagglutinin__InfluenzaA__AGW01415

SEQ ID NO: 71532 - RNA, 1701 nt, Artificial Sequence; identical to SEQ ID NO: 70866
  derived and/or modified sequence opt1 from hemagglutinin__InfluenzaA__AGW01427

SEQ ID NO: 71533 - RNA, 1701 nt, Artificial Sequence; identical to SEQ ID NO: 70866
  derived and/or modified sequence opt1 from hemagglutinin__InfluenzaA__AGW01439

SEQ ID NO: 71534 - RNA, 1701 nt, Artificial Sequence
  derived and/or modified sequence opt1 from hemagglutinin__InfluenzaA__AGW01451
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggucgacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71535 - RNA, 1701 nt, Artificial Sequence; identical to SEQ ID NO: 71002
  derived and/or modified sequence opt1 from hemagglutinin__InfluenzaA__AGW01463

SEQ ID NO: 71536 - RNA, 1701 nt, Artificial Sequence; identical to SEQ ID NO: 71002
  derived and/or modified sequence opt1 from hemagglutinin__InfluenzaA__AGW01475

SEQ ID NO: 71537 - RNA, 1701 nt, Artificial Sequence
  derived and/or modified sequence opt1 from hemagglutinin__InfluenzaA__AGW01487
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccacuccaacuucaaguaccccgcccugaacgugacgaugcccaacaacgagcaguucgacaagcuguacaucuggggcguccaccaccccgggaccgggaaggaccagaucuuccucuacgcgcagagcuccggccgcaucaccgugagcaccaagcggagccagcaggccgugaucccgaacaucggcucccgcccccggauccgcaacauccccagccggaucuccaucuacuggacgaucgucaagcccggggacauccugcugaucaacagcaccggcaaccucaucgccccgcgcggguacuucaagauccgguccggcaagagcuccaucaugcgcagcgacgcccccaucggcaagugcaaguccgagugcaucacccccaacgggagcauccccaacgacaagccguuccagaacgugaaccggaucaccuacggcgccugcccccgcuacgugaagcaguccacgcugaagcuggcgaccgggaugcggaacguccccgagaagcagacccgcggcaucuucggggccaucgccggcuucaucgagaacggcugggaggggaugauggacggcugguacggguuccggcaccagaacagcgagggccgcgggcaggccgccgaccucaaguccacccaggcggccaucgaccagaucaacggcaagcugaaccggcugaucggcaagacgaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcguggagcucaagagcggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 71538 - RNA, 1701 nt, Artificial Sequence; identical to SEQ ID NO: 70866
  derived and/or modified sequence opt1 from hemagglutinin__InfluenzaA__AGW01499

SEQ ID NO: 71539 - RNA, 1701 nt, Artificial Sequence
  derived and/or modified sequence opt1 from hemagglutinin__InfluenzaA__AGW01511
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcgccgcgcugcucggguucaucaugugggccugccagaagggcaacauccggugcaacaucugcaucuga

SEQ ID NO: 71540 - RNA, 1701 nt, Artificial Sequence
  derived and/or modified sequence opt1 from hemagglutinin__InfluenzaA__AGW01535
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaaggaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 71541 - RNA, 1701 nt, Artificial Sequence; identical to SEQ ID NO: 70866
  derived and/or modified sequence opt1 from hemagglutinin__InfluenzaA__AGW01547

SEQ ID NO: 71542 - RNA, 1701 nt, Artificial Sequence; identical to SEQ ID NO: 71002
  derived and/or modified sequence opt1 from hemagglutinin__InfluenzaA__AGW01559

SEQ ID NO: 71543 - RNA, 1701 nt, Artificial Sequence; identical to SEQ ID NO: 71002
  derived and/or modified sequence opt1 from hemagglutinin__InfluenzaA__AGW01571

SEQ ID NO: 71544 - RNA, 1701 nt, Artificial Sequence; identical to SEQ ID NO: 71002
  derived and/or modified sequence opt1 from hemagglutinin__InfluenzaA__AGW01583

SEQ ID NO: 71545 - RNA, 1701 nt, Artificial Sequence; identical to SEQ ID NO: 71002
  derived and/or modified sequence opt1 from hemagglutinin__InfluenzaA__AGW01595

SEQ ID NO: 71546 - RNA, 1701 nt, Artificial Sequence
  derived and/or modified sequence opt1 from hemagglutinin__InfluenzaA__AGW01607
augaagaccaucaucgcccugagcuacauccucugccuggugcuggcccagaagcuccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacagcccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcagccuggucgccuccagcggcacccuggaguucaacaacgaguccuucaacugggccggggugacgcagaacggcaccagcuccgccugcauccgggggagcaacuccagcuucuucucccgccucaacuggcugacccaccugaacuucaaguaccccgcgcucaacgugaccaugcccaacaacgagcaguucgacaagcuguacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccuccugaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccucaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcugugcguggcccuccugggguucaucaugugggcgugccagaagggcaacauccggugcaacaucugcaucuga

SEQ ID NO: 71547 - RNA, 1701 nt, Artificial Sequence; identical to SEQ ID NO: 71005
  derived and/or modified sequence opt1 from hemagglutinin__InfluenzaA__AGW01619

SEQ ID NO: 71548 - RNA, 1701 nt, Artificial Sequence; identical to SEQ ID NO: 71002
  derived and/or modified sequence opt1 from hemagglutinin__InfluenzaA__AGW01631

SEQ ID NO: 71549 - RNA, 1701 nt, Artificial Sequence
  derived and/or modified sequence opt1 from hemagglutinin__InfluenzaA__AGW01643
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccgggggagcaacuccagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccggaucaccgugagcaccaagcgcagccagcaggccgugaucccgaacaucggcucccggccccgcauccggaacauccccagccgcaucuccaucuacuggacgaucgucaagcccggggacauccugcucaucaacagcaccggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugauggacggcugguacggguuccgccaccagaacagcgagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 71550 - RNA, 1701 nt, Artificial Sequence; identical to SEQ ID NO: 71002
  derived and/or modified sequence opt1 from hemagglutinin__InfluenzaA__AGW01655

SEQ ID NO: 71551 - RNA, 1701 nt, Artificial Sequence
  derived and/or modified sequence opt1 from hemagglutinin__InfluenzaA__AGW01667
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacugggccggggugacgcagaacggcaccagcuccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcagccagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagagcuccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgagacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 71552 - RNA, 1701 nt, Artificial Sequence; identical to SEQ ID NO: 71002
  derived and/or modified sequence opt1 from hemagglutinin__InfluenzaA__AGW01679

SEQ ID NO: 71553 - RNA, 1701 nt, Artificial Sequence
  derived and/or modified sequence opt1 from hemagglutinin__InfluenzaA__AGW01691
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucgugaugugggccugccagaaggggaacauccgcugcaacaucugcaucuga

SEQ ID NO: 71554 - RNA, 1701 nt, Artificial Sequence; identical to SEQ ID NO: 70866
  derived and/or modified sequence opt1 from hemagglutinin__InfluenzaA__AGW01701

SEQ ID NO: 71555 - RNA, 1701 nt, Artificial Sequence; identical to SEQ ID NO: 70866
  derived and/or modified sequence opt1 from hemagglutinin__InfluenzaA__AGW01713

SEQ ID NO: 71556 - RNA, 1701 nt, Artificial Sequence
  derived and/or modified sequence opt1 from hemagglutinin__InfluenzaA__AGW01725
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggagccagcaggccgugaucccgaacaucggcucccgcccccggauccgcaacauccccagccggaucuccaucuacuggacgaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugaucugcguggcccugcugggcuucaucaugugggccugccagaaggggaacauccgcugcaacaucugcaucuga

SEQ ID NO: 71557 - RNA, 1701 nt, Artificial Sequence; identical to SEQ ID NO: 70866
  derived and/or modified sequence opt1 from hemagglutinin__InfluenzaA__AGW01737

SEQ ID NO: 71558 - RNA, 1701 nt, Artificial Sequence; identical to SEQ ID NO: 71002
  derived and/or modified sequence opt1 from hemagglutinin__InfluenzaA__AGW01749

SEQ ID NO: 71559 - RNA, 1701 nt, Artificial Sequence; identical to SEQ ID NO: 71002
  derived and/or modified sequence opt1 from hemagglutinin__InfluenzaA__AGW01761

SEQ ID NO: 71560 - RNA, 1701 nt, Artificial Sequence; identical to SEQ ID NO: 70866
  derived and/or modified sequence opt1 from hemagglutinin__InfluenzaA__AGW01773

SEQ ID NO: 71561 - RNA, 1701 nt, Artificial Sequence; identical to SEQ ID NO: 71002
  derived and/or modified sequence opt1 from hemagglutinin__InfluenzaA__AGW01785

SEQ ID NO: 71562 - RNA, 1701 nt, Artificial Sequence; identical to SEQ ID NO: 70866
  derived and/or modified sequence opt1 from hemagglutinin__InfluenzaA__AGW01797

SEQ ID NO: 71563 - RNA, 1701 nt, Artificial Sequence; identical to SEQ ID NO: 71002
  derived and/or modified sequence opt1 from hemagglutinin__InfluenzaA__AGW01809

SEQ ID NO: 71564 - RNA, 1701 nt, Artificial Sequence; identical to SEQ ID NO: 71002
  derived and/or modified sequence opt1 from hemagglutinin__InfluenzaA__AGW01821

SEQ ID NO: 71565 - RNA, 1701 nt, Artificial Sequence; identical to SEQ ID NO: 71001
  derived and/or modified sequence opt1 from hemagglutinin__InfluenzaA__AGW01833

SEQ ID NO: 71566 - RNA, 1701 nt, Artificial Sequence
  derived and/or modified sequence opt1 from hemagglutinin__InfluenzaA__AGW01845
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucacgaacgaguccuucaacuggaccggggugacccagaacggcaccagcuccgccugcauccggcgcagcaacuccagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcgcaucaccgugagcacgaagcggagccagcaggccgugaucccgaacaucggcucccgcccccggauccgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaaguccgagugcaucacccccaacggcagcauccccaacgacaagccguuccagaacgugaaccggaucacguacggggccugcccccgcuacgugaagcaguccacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 71567 - RNA, 1701 nt, Artificial Sequence; identical to SEQ ID NO: 71002
  derived and/or modified sequence opt1 from hemagglutinin__InfluenzaA__AGW01857

SEQ ID NO: 71568 - RNA, 1701 nt, Artificial Sequence; identical to SEQ ID NO: 71002
  derived and/or modified sequence opt1 from hemagglutinin__InfluenzaA__AGW01869

SEQ ID NO: 71569 - RNA, 1701 nt, Artificial Sequence; identical to SEQ ID NO: 71553
  derived and/or modified sequence opt1 from hemagglutinin__InfluenzaA__AGW01881

SEQ ID NO: 71570 - RNA, 1701 nt, Artificial Sequence; identical to SEQ ID NO: 70876
  derived and/or modified sequence opt1 from hemagglutinin__InfluenzaA__AGW01893

SEQ ID NO: 71571 - RNA, 1701 nt, Artificial Sequence; identical to SEQ ID NO: 70891
  derived and/or modified sequence opt1 from hemagglutinin__InfluenzaA__AGW01905

SEQ ID NO: 71572 - RNA, 1701 nt, Artificial Sequence; identical to SEQ ID NO: 71002
  derived and/or modified sequence opt1 from hemagglutinin__InfluenzaA__AGW01917

SEQ ID NO: 71573 - RNA, 1701 nt, Artificial Sequence; identical to SEQ ID NO: 70866
  derived and/or modified sequence opt1 from hemagglutinin__InfluenzaA__AGW01929

SEQ ID NO: 71574 - RNA, 1701 nt, Artificial Sequence; identical to SEQ ID NO: 71002
  derived and/or modified sequence opt1 from hemagglutinin__InfluenzaA__AGW01941

SEQ ID NO: 71575 - RNA, 1701 nt, Artificial Sequence; identical to SEQ ID NO: 70866
  derived and/or modified sequence opt1 from hemagglutinin__InfluenzaA__AGW01953

SEQ ID NO: 71576 - RNA, 1701 nt, Artificial Sequence
  derived and/or modified sequence opt1 from hemagglutinin__InfluenzaA__AGW01965
augaagaccaucaucgcccugagcuacauccucugccugguguucgcccaggagcugcccggcaacgacgacuccauggcgacccucugccuggggcaccacgccgucccgaacggcacgaucgugaagaccaucaccaacgaccagaucgaggugaccaacgccacggagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccagcgggcggaucaccguguccaccaagcgcagccagcaggccgugaucccgaacaucggcagccggccccgcguccggaacauccccucccgcgugagcaucuacuggacgaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagacgaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgacugcaucggguccauccgcaacggcaccuacgaccacaacguguaccgggacgaggcccucaacaaccgcuuccagaucaaggggaucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 71577 - RNA, 1701 nt, Artificial Sequence; identical to SEQ ID NO: 71002
  derived and/or modified sequence opt1 from hemagglutinin__InfluenzaA__AGW01977

SEQ ID NO: 71578 - RNA, 1701 nt, Artificial Sequence; identical to SEQ ID NO: 71002
  derived and/or modified sequence opt1 from hemagglutinin__InfluenzaA__AGW01989

SEQ ID NO: 71579 - RNA, 1701 nt, Artificial Sequence; identical to SEQ ID NO: 71002
  derived and/or modified sequence opt1 from hemagglutinin__InfluenzaA__AGW02001

SEQ ID NO: 71580 - RNA, 1701 nt, Artificial Sequence; identical to SEQ ID NO: 71002
  derived and/or modified sequence opt1 from hemagglutinin__InfluenzaA__AGW02013

SEQ ID NO: 71581 - RNA, 1701 nt, Artificial Sequence; identical to SEQ ID NO: 70866
  derived and/or modified sequence opt1 from hemagglutinin__InfluenzaA__AGW02025

SEQ ID NO: 71582 - RNA, 1701 nt, Artificial Sequence; identical to SEQ ID NO: 71002
  derived and/or modified sequence opt1 from hemagglutinin__InfluenzaA__AGW02037

SEQ ID NO: 71583 - RNA, 1701 nt, Artificial Sequence; identical to SEQ ID NO: 71002
  derived and/or modified sequence opt1 from hemagglutinin__InfluenzaA__AGW02061

SEQ ID NO: 71584 - RNA, 1701 nt, Artificial Sequence; identical to SEQ ID NO: 71002
  derived and/or modified sequence opt1 from hemagglutinin__InfluenzaA__AGW02073

SEQ ID NO: 71585 - RNA, 1701 nt, Artificial Sequence; identical to SEQ ID NO: 71002
  derived and/or modified sequence opt1 from hemagglutinin__InfluenzaA__AGW02085

SEQ ID NO: 71586 - RNA, 1701 nt, Artificial Sequence; identical to SEQ ID NO: 70891
  derived and/or modified sequence opt1 from hemagglutinin__InfluenzaA__AGW02097

SEQ ID NO: 71587 - RNA, 1701 nt, Artificial Sequence; identical to SEQ ID NO: 70866
  derived and/or modified sequence opt1 from hemagglutinin__InfluenzaA__AGW02109

SEQ ID NO: 71588 - RNA, 1701 nt, Artificial Sequence; identical to SEQ ID NO: 71002
  derived and/or modified sequence opt1 from hemagglutinin__InfluenzaA__AGW02133

SEQ ID NO: 71589 - RNA, 1701 nt, Artificial Sequence; identical to SEQ ID NO: 71002
  derived and/or modified sequence opt1 from hemagglutinin__InfluenzaA__AGW02157

SEQ ID NO: 71590 - RNA, 1701 nt, Artificial Sequence; identical to SEQ ID NO: 70866
  derived and/or modified sequence opt1 from hemagglutinin__InfluenzaA__AGW02169

SEQ ID NO: 71591 - RNA, 1701 nt, Artificial Sequence; identical to SEQ ID NO: 71002
  derived and/or modified sequence opt1 from hemagglutinin__InfluenzaA__AGW02181

SEQ ID NO: 71592 - RNA, 1701 nt, Artificial Sequence; identical to SEQ ID NO: 70876
  derived and/or modified sequence opt1 from hemagglutinin__InfluenzaA__AGW02193

SEQ ID NO: 71593 - RNA, 1701 nt, Artificial Sequence; identical to SEQ ID NO: 70843
  derived and/or modified sequence opt1 from hemagglutinin__InfluenzaA__AGW04171

SEQ ID NO: 71594 - RNA, 1707 nt, Artificial Sequence
  derived and/or modified sequence opt1 from hemagglutinin__InfluenzaA__AGW27061
auggagaagaucgugcugcuguucgccaucgucaaccuggucaagagcgaccacaucugcaucggcuaccacgccaacaacuccaccgagcaggucgacaccaucauggagaagaacgugacggugacccacgcgcaggacauccuggagaagacccacaacgggaagcucugcgaccugaacggcgugaagccccugauccucaaggacugcagcguggccggguggcugcugggcaacccgaugugcgacgaguucaucgacgugcccgagugguccuacaucguggagaaggccaaccccgccaacgaccucugcuaccccgggaacuucaacgacuacgaggagcugaagcaccuccucagccgcaucaaccacuucgagaagauccggaucaucccgaaggacuccuggcccgaccacgaggccagccugggcgucuccgcggccugcagcuaccagggcaacuccagcuucuuccgcaacgugguguggcugcucaagaagaacgacgccuaccccaucaucaagaaguccuacaacaacaccaacaaggaggaccugcugguccucugggggauccaccaccccaacgacgaggccgagcagauccggcuguaccagaacccgacgaccuacgugagcaccggcaccuccacgcugaaccagcgccucgugccccggaucgcgacccgcagcaaggucaacgggcaguccggccggaucgacuucuucuggaccauccugaagcccaacgacgccaucaacuucgagagcaacgggaacuucaucgcccccgaguacgccuacaagaucgugaagaagggcgacuccaccaucaugcgcagcgagguggaguacggcaacugcuccacgcggugccagaccccgaugggggccaucaacagcagcaugcccuuccacaacauccacccccugaccaucggcgagugccccaaguacgucaaguccaacaagcucgugcuggcgaccgggcugcgcaacagcccgcagaucgagcggcgccggcgcaagcggggccucuucggcgccaucgccggguucaucgagggcggguggcagggcaugguggacgggugguacggcuaccaccacuccaacgagcagggcagcggguacgccgccgacaaggaguccacgcagaaggcgaucgacggcgucaccaacaaggugaacagcaucaucgacaagaugaacacccaguucgaggccguggggcgcgaguucaacaaccuggagcggcgcaucgagaaccugaacaagaagauggaggacggcuuccucgacgucuggaccuacaacgccgagcugcuggugcucauggagaacgagcggacgcuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccgccucaagcgggaggagaucagcggggucaagcuggaguccaucggcaccuaccagauccugagcaucuacuccaccguggcgagcucccucgugcugagcaucauggucgccgggcugucccucuggaugugcagcaacggcucccugcagugccgcaugugcaucuga

SEQ ID NO: 71595 - RNA, 1698 nt, Artificial Sequence
  derived and/or modified sequence opt1 from hemagglutinin__InfluenzaA__AGY14471
augaaggugaagcugcucauccugcugugcaccuucaccgccacguacgccgacaccaucugcaucggcuaccacgcgaacaacagcaccgacaccgucgacacgauccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcggccuccugauccccaaggagagcugguccuacaucguggagacccccaaccccgagaacggcacgugcuacccgggguacuucgacgacuacgaggagcugcgcgagcagcucagcuccgucagcuccuucgagcgguucgagaucuuccccaaggagagcuccuggcccaaccacaccgugaccggcgugagcgccuccugcagccacaacgggaaguccagcuucuaccgcaaccugcuguggcucaccggcaagaacgggcuguaccccaaccuguccaagagcuacgccaacaacaaggagaaggagguccucauccuguggggcgugcaccacccguccaacaucggcaaccagcggacgcuguaccacaccgagaacaccuacgugagcgucgugagcucccacuacagccgccgguucacccccgagaucacgaagcgccccaaggugcgggaccaggaggggcgcaucaacuacuacuggacccuccuggagcccggcgacaccaucaucuucgaggccaacgggaaccugaucgccccgugguacgccuucgcccucuccaagggcuucggcagcgggaucaucaccuccaacgcgcccauggacgagugcgacgccaagugccagacgccccagggcgccaucaacagcaaccugcccuuccagaacguccacccggugaccaucggggagugccccaaguacgugcgguccaccaagcugcgcauggucaccggccuccggaacauccccagcauccagucccgcgggcuguucggcgccaucgccggcuucaucgagggcggguggacggggaugguggacggcugguacggguaccaccaccagaacgagcagggcagcggcuacgcggccgaccaggaguccacccagaacgccaucaacgggaucaccaacaaggugaacagcgucaucgagaagaugaacacccaguucacgguggugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgucaugaaccuguacgagaaggugaagggccagcugaagaacaacgccaaggagaucgggaacggcugcuucgaguucuaccacaagugcaacaacgagugcauggagagcgugaagaacggcaccuacgacuaccccaaguacuccgaggagagcaagcucaaccgcgagaagaucgacggggucaagcuggaguccaugggcguguaccagauccuggcgaucuacagcacgguggccuccagccucguccugcuggugagccucggggccaucuccuucuggaugugcagcaacggcucccugcagugccggaucugcaucuga

SEQ ID NO: 71596 - RNA, 1698 nt, Artificial Sequence; identical to SEQ ID NO: 71595
  derived and/or modified sequence opt1 from hemagglutinin__InfluenzaA__AGY14477

SEQ ID NO: 71597 - RNA, 1701 nt, Artificial Sequence
  derived and/or modified sequence opt1 from hemagglutinin__InfluenzaA__AHC57459
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcauccggaacauccccagccgcgucuccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 71598 - RNA, 1701 nt, Artificial Sequence; identical to SEQ ID NO: 67990
  derived and/or modified sequence opt1 from hemagglutinin__InfluenzaA__AHC57465

SEQ ID NO: 71599 - RNA, 1701 nt, Artificial Sequence; identical to SEQ ID NO: 67863
  derived and/or modified sequence opt1 from hemagglutinin__InfluenzaA__AHC57487

SEQ ID NO: 71600 - RNA, 1701 nt, Artificial Sequence; identical to SEQ ID NO: 68790
  derived and/or modified sequence opt1 from hemagglutinin__InfluenzaA__AHC57499

SEQ ID NO: 71601 - RNA, 1701 nt, Artificial Sequence; identical to SEQ ID NO: 68790
  derived and/or modified sequence opt1 from hemagglutinin__InfluenzaA__AHC57511

SEQ ID NO: 71602 - RNA, 1701 nt, Artificial Sequence; identical to SEQ ID NO: 68790
  derived and/or modified sequence opt1 from hemagglutinin__InfluenzaA__AHC57523

SEQ ID NO: 71603 - RNA, 1701 nt, Artificial Sequence; identical to SEQ ID NO: 67990
  derived and/or modified sequence opt1 from hemagglutinin__InfluenzaA__AHC57675

SEQ ID NO: 71604 - RNA, 1701 nt, Artificial Sequence; identical to SEQ ID NO: 67990
  derived and/or modified sequence opt1 from hemagglutinin__InfluenzaA__AHC57827

SEQ ID NO: 71605 - RNA, 1701 nt, Artificial Sequence; identical to SEQ ID NO: 67863
  derived and/or modified sequence opt1 from hemagglutinin__InfluenzaA__AHC57956

SEQ ID NO: 71606 - RNA, 1701 nt, Artificial Sequence
  derived and/or modified sequence opt1 from hemagglutinin__InfluenzaA__AHC57981
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccugaucgccuccagcggcacgcucgaguucaacaacgaguccuucaacuggaccggggucacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccuccgggcggaucaccgucagcacgaagcgcucccagcaggccgugaucccgaacaucggcagccggccccgcgugcggaacauccccagccgcaucuccaucuacuggaccaucgucaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaaccugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 71607 - RNA, 1701 nt, Artificial Sequence; identical to SEQ ID NO: 68790
  derived and/or modified sequence opt1 from hemagglutinin__InfluenzaA__AHC57993

SEQ ID NO: 71608 - RNA, 1701 nt, Artificial Sequence; identical to SEQ ID NO: 70082
  derived and/or modified sequence opt1 from hemagglutinin__InfluenzaA__AHC58005

SEQ ID NO: 71609 - RNA, 1701 nt, Artificial Sequence
  derived and/or modified sequence opt1 from hemagglutinin__InfluenzaA__AHC58017
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccgcuccgggaaguccuccaucaugcggagcgacgcgcccaucggcaagugcaacuccgccugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgugagcauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggcccugcucggcuucaucaugugggccugccagaagggcaacauccggugcaacaucugcaucuga

SEQ ID NO: 71610 - RNA, 1701 nt, Artificial Sequence
  derived and/or modified sequence opt1 from hemagglutinin__InfluenzaA__AHC58029
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcagcugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 71611 - RNA, 1701 nt, Artificial Sequence
  derived and/or modified sequence opt1 from hemagglutinin__InfluenzaA__AHC58050
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgcgccggucccagcaggccgugaucccgaacaucggcagccgcccccggauccgcaacauccccucccggaucagcaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucacguacggggccugcccccgcuacgugaagcagagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 71612 - RNA, 1701 nt, Artificial Sequence; identical to SEQ ID NO: 68790
  derived and/or modified sequence opt1 from hemagglutinin__InfluenzaA__AHC58074

SEQ ID NO: 71613 - RNA, 1701 nt, Artificial Sequence; identical to SEQ ID NO: 68790
  derived and/or modified sequence opt1 from hemagglutinin__InfluenzaA__AHC58098

SEQ ID NO: 71614 - RNA, 1701 nt, Artificial Sequence; identical to SEQ ID NO: 68790
  derived and/or modified sequence opt1 from hemagglutinin__InfluenzaA__AHC58110

SEQ ID NO: 71615 - RNA, 1701 nt, Artificial Sequence; identical to SEQ ID NO: 68790
  derived and/or modified sequence opt1 from hemagglutinin__InfluenzaA__AHC58126

SEQ ID NO: 71616 - RNA, 1701 nt, Artificial Sequence; identical to SEQ ID NO: 68790
  derived and/or modified sequence opt1 from hemagglutinin__InfluenzaA__AHC58138

SEQ ID NO: 71617 - RNA, 1701 nt, Artificial Sequence; identical to SEQ ID NO: 68790
  derived and/or modified sequence opt1 from hemagglutinin__InfluenzaA__AHC58162

SEQ ID NO: 71618 - RNA, 1701 nt, Artificial Sequence; identical to SEQ ID NO: 70082
  derived and/or modified sequence opt1 from hemagglutinin__InfluenzaA__AHC58186

SEQ ID NO: 71619 - RNA, 1701 nt, Artificial Sequence
  derived and/or modified sequence opt1 from hemagglutinin__InfluenzaA__AHC58198
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccagaaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggacugccagaaggggaacauccggugcaacaucugcaucuga

SEQ ID NO: 71620 - RNA, 1701 nt, Artificial Sequence
  derived and/or modified sequence opt1 from hemagglutinin__InfluenzaA__AHC58210
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacugggccggggugacccagaacggcaccagcuccgccugcauccgccggagcaacaacuccuucuucagccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcggaucaccgugagcaccaagcgcucccagcaggccgugaucccgaacaucggcagccggccccgcguccggaacauccccagccgcaucuccaucuacuggacgaucgugaagcccggcgacauccugcucaucaacagcaccgggaaccugaucgccccgcggggcuacuucaagauccgcuccggcaagagcuccaucaugcggagcgacgcgcccaucgggaagugcaacuccgagugcaucacccccaacggcagcauccccaacgacaagccguuccagaacgugaaccgcaucaccuacggggccugcccccgguacgucaagcagaacacgcugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccucaagagcacccaggccgccaucgaccagaucaacgggaagcugaaccgccugaucggcaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 71621 - RNA, 1701 nt, Artificial Sequence; identical to SEQ ID NO: 67990
  derived and/or modified sequence opt1 from hemagglutinin__InfluenzaA__AHC58234

SEQ ID NO: 71622 - RNA, 1701 nt, Artificial Sequence; identical to SEQ ID NO: 68790
  derived and/or modified sequence opt1 from hemagglutinin__InfluenzaA__AHC58246

SEQ ID NO: 71623 - RNA, 1701 nt, Artificial Sequence; identical to SEQ ID NO: 67990
  derived and/or modified sequence opt1 from hemagglutinin__InfluenzaA__AHC58258

SEQ ID NO: 71624 - RNA, 1701 nt, Artificial Sequence; identical to SEQ ID NO: 67863
  derived and/or modified sequence opt1 from hemagglutinin__InfluenzaA__AHC58270

SEQ ID NO: 71625 - RNA, 1701 nt, Artificial Sequence
  derived and/or modified sequence opt1 from hemagglutinin__InfluenzaA__AHC58372
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaccccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagagcacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 71626 - RNA, 1701 nt, Artificial Sequence
  derived and/or modified sequence opt1 from hemagglutinin__InfluenzaA__AHC58396
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 71627 - RNA, 1701 nt, Artificial Sequence; identical to SEQ ID NO: 68790
  derived and/or modified sequence opt1 from hemagglutinin__InfluenzaA__AHC58408

SEQ ID NO: 71628 - RNA, 1701 nt, Artificial Sequence; identical to SEQ ID NO: 70082
  derived and/or modified sequence opt1 from hemagglutinin__InfluenzaA__AHC58420

SEQ ID NO: 71629 - RNA, 1701 nt, Artificial Sequence; identical to SEQ ID NO: 70082
  derived and/or modified sequence opt1 from hemagglutinin__InfluenzaA__AHC58432

SEQ ID NO: 71630 - RNA, 1701 nt, Artificial Sequence; identical to SEQ ID NO: 67990
  derived and/or modified sequence opt1 from hemagglutinin__InfluenzaA__AHC58444

SEQ ID NO: 71631 - RNA, 1701 nt, Artificial Sequence; identical to SEQ ID NO: 71626
  derived and/or modified sequence opt1 from hemagglutinin__InfluenzaA__AHC58456

SEQ ID NO: 71632 - RNA, 1701 nt, Artificial Sequence
  derived and/or modified sequence opt1 from hemagglutinin__InfluenzaA__AHC58468
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucaacuacgaggagcuccgggagcagcugagcuccgugagcuccuucgagcgcuucgagaucuuccccaagaccagcuccuggcccaaccacgacagcaacaagggggucaccgccgccugcccgcaggccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagagcacccagaacgccaucgacaagaucaccaacaaggugaacuccgucaucgagaagaugaacacccaguucacggccgugggcaaggaguucaaccaccuggagcggcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcucaaccgggaggagaucgacggcgugaagcuggagagcacccgcaucuaccagauccuggccaucuacuccaccgucgccagcagccucgugcugguggucucccugggggccaucagcuucuggaugugcuccaacggcagccuccagugccggaucugcaucuga

SEQ ID NO: 71633 - RNA, 1701 nt, Artificial Sequence
  derived and/or modified sequence opt1 from hemagglutinin__InfluenzaA__AHC58479
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucaaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuucaagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 71634 - RNA, 1701 nt, Artificial Sequence; identical to SEQ ID NO: 71626
  derived and/or modified sequence opt1 from hemagglutinin__InfluenzaA__AHC58491

SEQ ID NO: 71635 - RNA, 1701 nt, Artificial Sequence; identical to SEQ ID NO: 67990
  derived and/or modified sequence opt1 from hemagglutinin__InfluenzaA__AHC58515

SEQ ID NO: 71636 - RNA, 1701 nt, Artificial Sequence; identical to SEQ ID NO: 68790
  derived and/or modified sequence opt1 from hemagglutinin__InfluenzaA__AHC58527

SEQ ID NO: 71637 - RNA, 1701 nt, Artificial Sequence
  derived and/or modified sequence opt1 from hemagglutinin__InfluenzaA__AHC58563
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 71638 - RNA, 1701 nt, Artificial Sequence; identical to SEQ ID NO: 68790
  derived and/or modified sequence opt1 from hemagglutinin__InfluenzaA__AHC58575

SEQ ID NO: 71639 - RNA, 1701 nt, Artificial Sequence; identical to SEQ ID NO: 67863
  derived and/or modified sequence opt1 from hemagglutinin__InfluenzaA__AHC58587

SEQ ID NO: 71640 - RNA, 1701 nt, Artificial Sequence; identical to SEQ ID NO: 67990
  derived and/or modified sequence opt1 from hemagglutinin__InfluenzaA__AHC58599

SEQ ID NO: 71641 - RNA, 1701 nt, Artificial Sequence; identical to SEQ ID NO: 68790
  derived and/or modified sequence opt1 from hemagglutinin__InfluenzaA__AHC58611

SEQ ID NO: 71642 - RNA, 1701 nt, Artificial Sequence; identical to SEQ ID NO: 68790
  derived and/or modified sequence opt1 from hemagglutinin__InfluenzaA__AHC58623

SEQ ID NO: 71643 - RNA, 1701 nt, Artificial Sequence; identical to SEQ ID NO: 68790
  derived and/or modified sequence opt1 from hemagglutinin__InfluenzaA__AHC58647

SEQ ID NO: 71644 - RNA, 1701 nt, Artificial Sequence; identical to SEQ ID NO: 67990
  derived and/or modified sequence opt1 from hemagglutinin__InfluenzaA__AHC58659

SEQ ID NO: 71645 - RNA, 1701 nt, Artificial Sequence; identical to SEQ ID NO: 67863
  derived and/or modified sequence opt1 from hemagglutinin__InfluenzaA__AHC58671

SEQ ID NO: 71646 - RNA, 1701 nt, Artificial Sequence; identical to SEQ ID NO: 70082
  derived and/or modified sequence opt1 from hemagglutinin__InfluenzaA__AHC58683

SEQ ID NO: 71647 - RNA, 1701 nt, Artificial Sequence; identical to SEQ ID NO: 67863
  derived and/or modified sequence opt1 from hemagglutinin__InfluenzaA__AHC58695

SEQ ID NO: 71648 - RNA, 1701 nt, Artificial Sequence; identical to SEQ ID NO: 70082
  derived and/or modified sequence opt1 from hemagglutinin__InfluenzaA__AHC58707

SEQ ID NO: 71649 - RNA, 1701 nt, Artificial Sequence; identical to SEQ ID NO: 70082
  derived and/or modified sequence opt1 from hemagglutinin__InfluenzaA__AHC58719

SEQ ID NO: 71650 - RNA, 1701 nt, Artificial Sequence; identical to SEQ ID NO: 71626
  derived and/or modified sequence opt1 from hemagglutinin__InfluenzaA__AHC58731

SEQ ID NO: 71651 - RNA, 1701 nt, Artificial Sequence
  derived and/or modified sequence opt1 from hemagglutinin__InfluenzaA__AHC58743
augaagaccaucaucgccuggagcuacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaacagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 71652 - RNA, 1701 nt, Artificial Sequence; identical to SEQ ID NO: 71626
  derived and/or modified sequence opt1 from hemagglutinin__InfluenzaA__AHC58755

SEQ ID NO: 71653 - RNA, 1701 nt, Artificial Sequence; identical to SEQ ID NO: 67863
  derived and/or modified sequence opt1 from hemagglutinin__InfluenzaA__AHC58779

SEQ ID NO: 71654 - RNA, 1701 nt, Artificial Sequence; identical to SEQ ID NO: 71625
  derived and/or modified sequence opt1 from hemagglutinin__InfluenzaA__AHC58791

SEQ ID NO: 71655 - RNA, 1701 nt, Artificial Sequence
  derived and/or modified sequence opt1 from hemagglutinin__InfluenzaA__AHC58803
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagaucaucgacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugaaguccgacgcccccaucgggaagugcaacagcgagugcaucacccccaacggcagcauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgggagaacgcggaggacauggggaacggcugcuucaagaucuaccacaagugcgacaacgccugcaucgggagcauccgcaacggcaccuacgaccacgacgucuaccgcgacgaggcccugaacaaccgguucaagaucaaggggguggagcucaaguccggcuacaaggacuggauccuguggaucagcuucgccaucuccugcuuccugcucugcguggcccugcugggcuucaucaugugggcgugccagaaggggaacauccgcugcaacaucugcaucuga

SEQ ID NO: 71656 - RNA, 1701 nt, Artificial Sequence
  derived and/or modified sequence opt1 from hemagglutinin__InfluenzaA__AHC58815
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgggaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcaggccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacagcgagggccgggggcaggccgcggaccugaaguccacgcaggccgccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacaacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 71657 - RNA, 1701 nt, Artificial Sequence; identical to SEQ ID NO: 67863
  derived and/or modified sequence opt1 from hemagglutinin__InfluenzaA__AHC58827

SEQ ID NO: 71658 - RNA, 1701 nt, Artificial Sequence; identical to SEQ ID NO: 68790
  derived and/or modified sequence opt1 from hemagglutinin__InfluenzaA__AHC58839

SEQ ID NO: 71659 - RNA, 1701 nt, Artificial Sequence
  derived and/or modified sequence opt1 from hemagglutinin__InfluenzaA__AHC58863
augaagaccaucaucgcccugagcuacauccucugccugguguucgcccagaagcugcccggcaacgacaacuccaccgcgacgcucugccuggggcaccacgccgucagcaacggcaccaucgugaagaccaucaccaacgaccagaucgaggugacgaacgccaccgagcugguccaguccagcuccaccggggagaucugcaacagcccgcaccagauccucgacggcgagaacugcacccugaucgacgcccugcucggggacccccagugcgacggcuuccagaacaagaagugggaccuguucguggagcgcuccaaggcccacagcaacugcuaccccuacgacgugcccgacuacgcgucccugcggagccucgucgccuccagcggcacgcuggaguucaacaacgaguccuucaacuggaccggggugacccagaacggcaccagcuccgccugcauccgcgggagcaacaacuccuucuucagccggcugaacuggcucacgcaccugaacuucaaguacccggcccugaacgugaccaugcccaacaacgagcaguucgacaagcucuacaucuggggcguccaccaccccgggaccgacaaggaccagaucuuccuguacgcgcaggccuccggccgcaucaccgugagcacgaagcggagccagcaggccgugauccccaacaucggcucccgcccgcggguccgcaacauccccagccggguguccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgccugcaucacccccaacgggagcauccccaacgacaagcccuuccagaacgucaaccggaucacguacggcgccugcccgcgcuacgugaagcagaacacccugaagcucgccaccgggaugcggaacgugcccgagaagcagacccgcggcaucuucggggccaucgccggcuucaucgagaacggcugggaggggaugauggacggcugguacggguuccggcaccagaacuccgagggccgcgggcaggcggccgaccucaagagcacgcaggccgccaucgaccagaucaacggcaagcugaaccggcugaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgggagaacgccgaggacaugggcaacgggugcuucaagaucuaccacaagugcgacaacgccugcaucggcagcauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcgcugcucggguucaucaugugggccugccagaagggcaacauccgcugcaacaucugcaucuga

SEQ ID NO: 71660 - RNA, 1701 nt, Artificial Sequence; identical to SEQ ID NO: 67863
  derived and/or modified sequence opt1 from hemagglutinin__InfluenzaA__AHC58875

SEQ ID NO: 71661 - RNA, 1701 nt, Artificial Sequence; identical to SEQ ID NO: 68790
  derived and/or modified sequence opt1 from hemagglutinin__InfluenzaA__AHC58887

SEQ ID NO: 71662 - RNA, 1701 nt, Artificial Sequence; identical to SEQ ID NO: 71626
  derived and/or modified sequence opt1 from hemagglutinin__InfluenzaA__AHC58899

SEQ ID NO: 71663 - RNA, 1701 nt, Artificial Sequence; identical to SEQ ID NO: 68790
  derived and/or modified sequence opt1 from hemagglutinin__InfluenzaA__AHC58981

SEQ ID NO: 71664 - RNA, 1701 nt, Artificial Sequence; identical to SEQ ID NO: 68790
  derived and/or modified sequence opt1 from hemagglutinin__InfluenzaA__AHC58993

SEQ ID NO: 71665 - RNA, 1701 nt, Artificial Sequence; identical to SEQ ID NO: 68790
  derived and/or modified sequence opt1 from hemagglutinin__InfluenzaA__AHC59005

SEQ ID NO: 71666 - RNA, 1701 nt, Artificial Sequence
  derived and/or modified sequence opt1 from hemagglutinin__InfluenzaA__AHC59017
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacagcgagauguccaagcuguucgagaagaccaagaagcagcugcgggagaacgccgaggacaugggcaacgggugcuucaagaucuaccacaagugcgacaacgccugcaucggcagcauccgcaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcgcugcucggguucaucaugugggccugccagaagggcaacauccgcugcaacaucugcaucuga

SEQ ID NO: 71667 - RNA, 1701 nt, Artificial Sequence; identical to SEQ ID NO: 71626
  derived and/or modified sequence opt1 from hemagglutinin__InfluenzaA__AHC59029

SEQ ID NO: 71668 - RNA, 1701 nt, Artificial Sequence; identical to SEQ ID NO: 67990
  derived and/or modified sequence opt1 from hemagglutinin__InfluenzaA__AHC59041

SEQ ID NO: 71669 - RNA, 1701 nt, Artificial Sequence
  derived and/or modified sequence opt1 from hemagglutinin__InfluenzaA__AHC59053
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugagcacgaagcgcucccagcaggccgugaucccgaacaucggcagccggccccgcguccggaacauccccagccgcguguccaucuacuggaccaucgugaagcccggcgacauccugcucaucaacagcaccgggaaccugaucgccccgcggggcuacuucaagauccaguccgggaaguccuccaucaugcgcagcgacgcgcccaucggcaagugcaacuccgccugcaucacccccaacggcagcauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacuccgaggggcgcggccaggccgccgaccucaagagcacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacguguaccgcgacgaggcccucaacaaccgguuccagaucaaggggguggagcugaaguccggcuacaaggacuggauccuguggaucagcuucgcgaucuccugcuuccuccugugcgucgcccugcucggcuucaucauguggaccugccagaaggggaacauccgcugcaacaucugcaucuga

SEQ ID NO: 71670 - RNA, 1701 nt, Artificial Sequence
  derived and/or modified sequence opt1 from hemagglutinin__InfluenzaA__AHC59077
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgugguccugcucggcuucaucaugugggccugccagaaggggaacauccggugcaacaucugcaucuga

SEQ ID NO: 71671 - RNA, 1701 nt, Artificial Sequence; identical to SEQ ID NO: 70082
  derived and/or modified sequence opt1 from hemagglutinin__InfluenzaA__AHC59089

SEQ ID NO: 71672 - RNA, 1701 nt, Artificial Sequence; identical to SEQ ID NO: 68790
  derived and/or modified sequence opt1 from hemagglutinin__InfluenzaA__AHC59101

SEQ ID NO: 71673 - RNA, 1701 nt, Artificial Sequence; identical to SEQ ID NO: 67990
  derived and/or modified sequence opt1 from hemagglutinin__InfluenzaA__AHC59113

SEQ ID NO: 71674 - RNA, 1701 nt, Artificial Sequence; identical to SEQ ID NO: 68790
  derived and/or modified sequence opt1 from hemagglutinin__InfluenzaA__AHC59125

SEQ ID NO: 71675 - RNA, 1701 nt, Artificial Sequence
  derived and/or modified sequence opt1 from hemagglutinin__InfluenzaA__AHC59137
augaagaccaucaucgcccugagcuacauccucugccugguguucgcccagaagauccccggcaacgacaacuccaccgcgacgcugugccucgggcaccacgccgucagcaacggcaccaucgugaagaccaucaccaacgaccagaucgaggugacgaacgccaccgagcugguccaguccagcuccaccggggagaucugcaacagcccgcaccagauccuggacggcgagaacugcacccucaucgacgcccugcugggggacccccagugcgacggcuuccagaacaagaagugggaccucuucguggagcgcuccaaggcccacagcaacugcuaccccuacgacgugcccgacuacgcgucccugcggagccuggucgccuccagcggcacgcucgaguucaacaacgaguccuucaacuggaccggggugacccagaacggcaccagcuccgccugcauccgcgggagcaacaacuccuucuucagccggcugaacuggcugacgcaccucaacuucaaguacccggcccugaacgugaccaugcccaacaacgagcaguucgacaagcuguacaucuggggcguccaccaccccgggaccgacaaggaccagaucuuccucuacgcgcaggccuccggccgcaucaccgugagcacgaagcggagccagcaggccgugauccccaacaucggcucccgcccgcggguccgcaacauccccagccggguguccaucuacuggaccaucgugaagcccggggacauccugcugaucaacagcaccggcaaccucaucgcgccccgcggguacuucaagauccgguccggcaagagcuccaucaugcgcagcgacgccccgaucggcaagugcaacuccgccugcaucacccccaacgggagcauccccaacgacaagcccuuccagaacgucaaccggaucacguacggcgccugcccgcgcuacgugaagcagaacacccugaagcuggccaccgggaugcggaacgugcccgagaagcagacccgcggcaucuucggggccaucgccggcuucaucgagaacggcugggaggggaugauggacggcugguacggguuccggcaccagaacuccgagggccgcgggcaggcggccgaccucaagagcacgcaggccgccaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcgcuggagaaccagcacaccaucgaccugacggacuccgagaugaacaagcuguucgagaagaccaagaagcagcuccgggagaacgccgaggacaugggcaacgggugcuucaagaucuaccacaagugcgacaacgccugcaucggcagcauccgcaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcguggcgcugcugggguucaucaugugggccugccagaagggcaacauccgcugcaacaucugcaucuga

SEQ ID NO: 71676 - RNA, 1701 nt, Artificial Sequence; identical to SEQ ID NO: 67990
  derived and/or modified sequence opt1 from hemagglutinin__InfluenzaA__AHC59149

SEQ ID NO: 71677 - RNA, 1701 nt, Artificial Sequence
  derived and/or modified sequence opt1 from hemagglutinin__InfluenzaA__AHC59185
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 71678 - RNA, 1701 nt, Artificial Sequence; identical to SEQ ID NO: 67863
  derived and/or modified sequence opt1 from hemagglutinin__InfluenzaA__AHC59197

SEQ ID NO: 71679 - RNA, 1701 nt, Artificial Sequence
  derived and/or modified sequence opt1 from hemagglutinin__InfluenzaA__AHC59209
augaagaccaucaucgcccugagcuacauccucugccugguguucgcccaggagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcaacagcccccaccagauccuggacggcgagaacugcacccucaucgacgcccugcugggggacccccagugcgacgacuuccagaacaagaagugggaccucuucguggagcgcuccaaggcccacuccaacugcuaccccuacgacgugccggacuacgcgagccugcggucccuggucgccagcuccggcacgcucgaguucaacaacgagagcuucaacuggaccggcgugacccagaacgggaccuccagcgccugcauccgccgguccaacaacagcuucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcggccggaucaccguguccacgaagcgcagccagcaggccgugaucccgaacaucgggagccggccccgcguccggaacauccccucccgcgugagcaucuacuggaccaucgugaagcccggcgacauccugcugaucaacuccaccggcaaccucaucgccccgcggggguacuucaagauccgcagcggcaaguccagcaucaugcgguccgacgcccccaucggggagugcaacagcgcgugcaucacccccaacggcuccauccccaacgacaagccguuccagaacgucaaccgcaucacguacggcgccugcccccgguacgugaagcagaacacccugaagcuggccaccgggaugcgcaacgugcccgagaagcagacccggggcaucuucggggccaucgccggcuucaucgagaacgggugggagggcauggucgacggcugguacggguuccgccaccagaacagcgagggccgggggcaggcggccgaccucaaguccacgcaggccgccaucgaccagaucaacggcaagcugaaccgccugaucgggaagaccaacgagaaguuccaccagaucgagaaggaguucagcgagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgccguguaccgggacgaggcccugaacaaccgcuuccagaucaagggcguggagcucaagagcggguacaaggacuggauccuguggaucuccuucgcgaucagcugcuuccugcucugcgucgcccugcugggcuucaucaugugggccugccagaagggcaacauccggugcaacaucugcaucuga

SEQ ID NO: 71680 - RNA, 1701 nt, Artificial Sequence; identical to SEQ ID NO: 67990
  derived and/or modified sequence opt1 from hemagglutinin__InfluenzaA__AHC59221

SEQ ID NO: 71681 - RNA, 1701 nt, Artificial Sequence; identical to SEQ ID NO: 71659
  derived and/or modified sequence opt1 from hemagglutinin__InfluenzaA__AHC59245

SEQ ID NO: 71682 - RNA, 1701 nt, Artificial Sequence; identical to SEQ ID NO: 71626
  derived and/or modified sequence opt1 from hemagglutinin__InfluenzaA__AHC59257

SEQ ID NO: 71683 - RNA, 1701 nt, Artificial Sequence; identical to SEQ ID NO: 68790
  derived and/or modified sequence opt1 from hemagglutinin__InfluenzaA__AHC59269

SEQ ID NO: 71684 - RNA, 1701 nt, Artificial Sequence; identical to SEQ ID NO: 71626
  derived and/or modified sequence opt1 from hemagglutinin__InfluenzaA__AHC59281

SEQ ID NO: 71685 - RNA, 1701 nt, Artificial Sequence; identical to SEQ ID NO: 67990
  derived and/or modified sequence opt1 from hemagglutinin__InfluenzaA__AHC59293

SEQ ID NO: 71686 - RNA, 1701 nt, Artificial Sequence
  derived and/or modified sequence opt1 from hemagglutinin__InfluenzaA__AHC59305
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcuccagcccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcaggccgugaucccgaacaucggcucccggccccgcguccggaacauccccagccgcguguccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 71687 - RNA, 1701 nt, Artificial Sequence
  derived and/or modified sequence opt1 from hemagglutinin__InfluenzaA__AHC59329
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccagcggcacccuggaguucaacaacgaguccuucaacuggacgggggugacccagaacggcaccagcuccgccugcauccggcgcagcaacaacuccuucuucagccggcugaacuggcucacccaccugaacuucaaguaccccgcccugaacgugacgaugcccaacaacgagcaguucgacaagcucuacaucuggggcguccaccaccccgggaccgagaaggaccagaucuuccuguacgcgcaguccagcgggcgcaucaccguguccaccaagcggagccagcaggccgugaucccgaacaucggcagccgcccccggauccgcaacauccccucccggaucagcaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagagcgagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 71688 - RNA, 1701 nt, Artificial Sequence; identical to SEQ ID NO: 70082
  derived and/or modified sequence opt1 from hemagglutinin__InfluenzaA__AHC59341

SEQ ID NO: 71689 - RNA, 1701 nt, Artificial Sequence; identical to SEQ ID NO: 71626
  derived and/or modified sequence opt1 from hemagglutinin__InfluenzaA__AHC59365

SEQ ID NO: 71690 - RNA, 1701 nt, Artificial Sequence
  derived and/or modified sequence opt1 from hemagglutinin__InfluenzaA__AHC59377
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggagccucguggccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccuccgggcggaucaccgugagcacgaagcgcucccagcaggccgucaucccgaacaucggcagccggccccgcgugcggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccagaaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggcgugccagaaggggaacauccggugcaacaucugcaucuga

SEQ ID NO: 71691 - RNA, 1701 nt, Artificial Sequence; identical to SEQ ID NO: 67990
  derived and/or modified sequence opt1 from hemagglutinin__InfluenzaA__AHC59413

SEQ ID NO: 71692 - RNA, 1701 nt, Artificial Sequence; identical to SEQ ID NO: 68790
  derived and/or modified sequence opt1 from hemagglutinin__InfluenzaA__AHC59425

SEQ ID NO: 71693 - RNA, 1701 nt, Artificial Sequence; identical to SEQ ID NO: 70082
  derived and/or modified sequence opt1 from hemagglutinin__InfluenzaA__AHC59437

SEQ ID NO: 71694 - RNA, 1701 nt, Artificial Sequence
  derived and/or modified sequence opt1 from hemagglutinin__InfluenzaA__AHC59449
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggccgcaccaacgagaaguuccaccagaucgagaaggaguucagcgagguggaggggcggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcgcugcucggguucaucaugugggccugccagaagggcaacauccggugcaacaucugcaucuga

SEQ ID NO: 71695 - RNA, 1701 nt, Artificial Sequence; identical to SEQ ID NO: 67863
  derived and/or modified sequence opt1 from hemagglutinin__InfluenzaA__AHC59461

SEQ ID NO: 71696 - RNA, 1701 nt, Artificial Sequence; identical to SEQ ID NO: 71687
  derived and/or modified sequence opt1 from hemagglutinin__InfluenzaA__AHC59473

SEQ ID NO: 71697 - RNA, 1701 nt, Artificial Sequence; identical to SEQ ID NO: 67990
  derived and/or modified sequence opt1 from hemagglutinin__InfluenzaA__AHC59485

SEQ ID NO: 71698 - RNA, 1701 nt, Artificial Sequence; identical to SEQ ID NO: 67990
  derived and/or modified sequence opt1 from hemagglutinin__InfluenzaA__AHC59497

SEQ ID NO: 71699 - RNA, 1701 nt, Artificial Sequence; identical to SEQ ID NO: 67863
  derived and/or modified sequence opt1 from hemagglutinin__InfluenzaA__AHC59509

SEQ ID NO: 71700 - RNA, 1701 nt, Artificial Sequence; identical to SEQ ID NO: 67863
  derived and/or modified sequence opt1 from hemagglutinin__InfluenzaA__AHC59521

SEQ ID NO: 71701 - RNA, 1701 nt, Artificial Sequence
  derived and/or modified sequence opt1 from hemagglutinin__InfluenzaA__AHC59533
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaagaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71702 - RNA, 1701 nt, Artificial Sequence; identical to SEQ ID NO: 67990
  derived and/or modified sequence opt1 from hemagglutinin__InfluenzaA__AHC59545

SEQ ID NO: 71703 - RNA, 1701 nt, Artificial Sequence; identical to SEQ ID NO: 71626
  derived and/or modified sequence opt1 from hemagglutinin__InfluenzaA__AHC59557

SEQ ID NO: 71704 - RNA, 1701 nt, Artificial Sequence
  derived and/or modified sequence opt1 from hemagglutinin__InfluenzaA__AHC59569
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 71705 - RNA, 1701 nt, Artificial Sequence; identical to SEQ ID NO: 67990
  derived and/or modified sequence opt1 from hemagglutinin__InfluenzaA__AHC59581

SEQ ID NO: 71706 - RNA, 1701 nt, Artificial Sequence; identical to SEQ ID NO: 67863
  derived and/or modified sequence opt1 from hemagglutinin__InfluenzaA__AHC59593

SEQ ID NO: 71707 - RNA, 1701 nt, Artificial Sequence; identical to SEQ ID NO: 70082
  derived and/or modified sequence opt1 from hemagglutinin__InfluenzaA__AHC59605

SEQ ID NO: 71708 - RNA, 1701 nt, Artificial Sequence; identical to SEQ ID NO: 67990
  derived and/or modified sequence opt1 from hemagglutinin__InfluenzaA__AHC59617

SEQ ID NO: 71709 - RNA, 1701 nt, Artificial Sequence; identical to SEQ ID NO: 67990
  derived and/or modified sequence opt1 from hemagglutinin__InfluenzaA__AHC59629

SEQ ID NO: 71710 - RNA, 1701 nt, Artificial Sequence; identical to SEQ ID NO: 71626
  derived and/or modified sequence opt1 from hemagglutinin__InfluenzaA__AHC59641

SEQ ID NO: 71711 - RNA, 1701 nt, Artificial Sequence
  derived and/or modified sequence opt1 from hemagglutinin__InfluenzaA__AHC59653
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgcagcgcagccagcaggccgugaucccgaacaucggcagccggccccgcguccggaacauccccucccgcgugagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 71712 - RNA, 1701 nt, Artificial Sequence; identical to SEQ ID NO: 67863
  derived and/or modified sequence opt1 from hemagglutinin__InfluenzaA__AHC59665

SEQ ID NO: 71713 - RNA, 1701 nt, Artificial Sequence; identical to SEQ ID NO: 67990
  derived and/or modified sequence opt1 from hemagglutinin__InfluenzaA__AHC59677

SEQ ID NO: 71714 - RNA, 1701 nt, Artificial Sequence; identical to SEQ ID NO: 71711
  derived and/or modified sequence opt1 from hemagglutinin__InfluenzaA__AHC59689

SEQ ID NO: 71715 - RNA, 1701 nt, Artificial Sequence; identical to SEQ ID NO: 71626
  derived and/or modified sequence opt1 from hemagglutinin__InfluenzaA__AHC59701

SEQ ID NO: 71716 - RNA, 1701 nt, Artificial Sequence; identical to SEQ ID NO: 67863
  derived and/or modified sequence opt1 from hemagglutinin__InfluenzaA__AHC59713

SEQ ID NO: 71717 - RNA, 1701 nt, Artificial Sequence; identical to SEQ ID NO: 71637
  derived and/or modified sequence opt1 from hemagglutinin__InfluenzaA__AHC59737

SEQ ID NO: 71718 - RNA, 1701 nt, Artificial Sequence; identical to SEQ ID NO: 67863
  derived and/or modified sequence opt1 from hemagglutinin__InfluenzaA__AHC59749

SEQ ID NO: 71719 - RNA, 1701 nt, Artificial Sequence; identical to SEQ ID NO: 67990
  derived and/or modified sequence opt1 from hemagglutinin__InfluenzaA__AHC59761

SEQ ID NO: 71720 - RNA, 1701 nt, Artificial Sequence; identical to SEQ ID NO: 67990
  derived and/or modified sequence opt1 from hemagglutinin__InfluenzaA__AHC59773

SEQ ID NO: 71721 - RNA, 1701 nt, Artificial Sequence; identical to SEQ ID NO: 68790
  derived and/or modified sequence opt1 from hemagglutinin__InfluenzaA__AHC59785

SEQ ID NO: 71722 - RNA, 1701 nt, Artificial Sequence; identical to SEQ ID NO: 67990
  derived and/or modified sequence opt1 from hemagglutinin__InfluenzaA__AHC59797

SEQ ID NO: 71723 - RNA, 1701 nt, Artificial Sequence; identical to SEQ ID NO: 70082
  derived and/or modified sequence opt1 from hemagglutinin__InfluenzaA__AHC59809

SEQ ID NO: 71724 - RNA, 1701 nt, Artificial Sequence
  derived and/or modified sequence opt1 from hemagglutinin__InfluenzaA__AHC59821
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggccugcagaacaagaagugggaccuguucguggagcgcuccaaggccuacagcaacugcuaccccuacgacgugccggacuacgcgucccuccggagccuggucgccuccagcggcacgcuggaguucaacaacgaguccuucaacuggaccggggugacccagaacggcaccagcuccgccugcauccgccggagcaacaacuccuucuucagccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccuccugaucaacagcaccgggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuggucgagaagaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcugaaguccggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 71725 - RNA, 1701 nt, Artificial Sequence; identical to SEQ ID NO: 71626
  derived and/or modified sequence opt1 from hemagglutinin__InfluenzaA__AHC59833

SEQ ID NO: 71726 - RNA, 1701 nt, Artificial Sequence; identical to SEQ ID NO: 71625
  derived and/or modified sequence opt1 from hemagglutinin__InfluenzaA__AHC59845

SEQ ID NO: 71727 - RNA, 1701 nt, Artificial Sequence; identical to SEQ ID NO: 68790
  derived and/or modified sequence opt1 from hemagglutinin__InfluenzaA__AHC59857

SEQ ID NO: 71728 - RNA, 1701 nt, Artificial Sequence; identical to SEQ ID NO: 67990
  derived and/or modified sequence opt1 from hemagglutinin__InfluenzaA__AHC59869

SEQ ID NO: 71729 - RNA, 1701 nt, Artificial Sequence; identical to SEQ ID NO: 67990
  derived and/or modified sequence opt1 from hemagglutinin__InfluenzaA__AHC59881

SEQ ID NO: 71730 - RNA, 1701 nt, Artificial Sequence; identical to SEQ ID NO: 67863
  derived and/or modified sequence opt1 from hemagglutinin__InfluenzaA__AHC59892

SEQ ID NO: 71731 - RNA, 1701 nt, Artificial Sequence
  derived and/or modified sequence opt1 from hemagglutinin__InfluenzaA__AHC59904
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcggguccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggagccagcaggccgugaucccgaacaucggcagccgcccccggguccgcaacauccccucccgggugagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggaugauggacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 71732 - RNA, 1701 nt, Artificial Sequence
  derived and/or modified sequence opt1 from hemagglutinin__InfluenzaA__AHC59915
augaagaccgugaucgcccugagcuacauccucugccuggccuucgcgcagaagcugcccggcaacgacaacuccaccgccacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcguacuccaacugcuaccccuacgacgugccggacuacgccagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 71733 - RNA, 1701 nt, Artificial Sequence; identical to SEQ ID NO: 67990
  derived and/or modified sequence opt1 from hemagglutinin__InfluenzaA__AHC59939

SEQ ID NO: 71734 - RNA, 1701 nt, Artificial Sequence
  derived and/or modified sequence opt1 from hemagglutinin__InfluenzaA__AHC59963
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugagcacgaagcgcucccagcaggccgugaucccgaacaucggcagccggccccgcauccggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggccugcccccgguacaucaagcagagcacccugaagcucgcgaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 71735 - RNA, 1701 nt, Artificial Sequence; identical to SEQ ID NO: 67863
  derived and/or modified sequence opt1 from hemagglutinin__InfluenzaA__AHC59987

SEQ ID NO: 71736 - RNA, 1701 nt, Artificial Sequence; identical to SEQ ID NO: 67863
  derived and/or modified sequence opt1 from hemagglutinin__InfluenzaA__AHC59999

SEQ ID NO: 71737 - RNA, 1701 nt, Artificial Sequence; identical to SEQ ID NO: 67990
  derived and/or modified sequence opt1 from hemagglutinin__InfluenzaA__AHC60011

SEQ ID NO: 71738 - RNA, 1701 nt, Artificial Sequence; identical to SEQ ID NO: 67863
  derived and/or modified sequence opt1 from hemagglutinin__InfluenzaA__AHC60023

SEQ ID NO: 71739 - RNA, 1701 nt, Artificial Sequence; identical to SEQ ID NO: 68790
  derived and/or modified sequence opt1 from hemagglutinin__InfluenzaA__AHC60035

SEQ ID NO: 71740 - RNA, 1701 nt, Artificial Sequence; identical to SEQ ID NO: 68790
  derived and/or modified sequence opt1 from hemagglutinin__InfluenzaA__AHC60047

SEQ ID NO: 71741 - RNA, 1701 nt, Artificial Sequence
  derived and/or modified sequence opt1 from hemagglutinin__InfluenzaA__AHC60059
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgcgugcaucacccccaacggcagcauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggagcauccgcaacggcaccuacaaccacgacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 71742 - RNA, 1701 nt, Artificial Sequence; identical to SEQ ID NO: 70082
  derived and/or modified sequence opt1 from hemagglutinin__InfluenzaA__AHC60071

SEQ ID NO: 71743 - RNA, 1701 nt, Artificial Sequence; identical to SEQ ID NO: 71626
  derived and/or modified sequence opt1 from hemagglutinin__InfluenzaA__AHC60083

SEQ ID NO: 71744 - RNA, 1701 nt, Artificial Sequence; identical to SEQ ID NO: 68790
  derived and/or modified sequence opt1 from hemagglutinin__InfluenzaA__AHC60095
